(12) United States Patent
Comeau et al.

(10) Patent No.: US 11,390,687 B2
(45) Date of Patent: Jul. 19, 2022

(54) BISPECIFIC ANTIBODIES AGAINST PLASMA KALLIKREIN AND FACTOR XII

(71) Applicant: Takeda Pharmaceutical Company Limited, Osaka (JP)

(72) Inventors: Stephen R. Comeau, Avon, NY (US); Andrew Nixon, Hanover, MA (US); Niksa Kastrapeli, Wellesley, MA (US); Jon A. Kenniston, Hingham, MA (US); Gregory P. Conley, Arlington, MA (US); Shauna Mason, Arlington, MA (US); Allison P. Lindberg, Arlington, MA (US); Kristopher Kopacz, Cumberland, RI (US); Burt Adelman, Concord, MA (US)

(73) Assignee: Takeda Pharmaceutical Company Limited, Osaka (JP)

(*) Notice: Subject to any disclaimer, the term of this patent is extended or adjusted under 35 U.S.C. 154(b) by 693 days.

(21) Appl. No.: 15/541,066

(22) PCT Filed: Dec. 31, 2015

(86) PCT No.: PCT/US2015/068238
§ 371 (c)(1),
(2) Date: Jun. 30, 2017

(87) PCT Pub. No.: WO2016/109774
PCT Pub. Date: Jul. 7, 2016

(65) Prior Publication Data
US 2018/0118851 A1    May 3, 2018

Related U.S. Application Data

(60) Provisional application No. 62/261,609, filed on Dec. 1, 2015, provisional application No. 62/200,363, filed on Aug. 3, 2015, provisional application No. 62/099,236, filed on Jan. 2, 2015.

(51) Int. Cl.
| | |
|---|---|
| *C07K 16/40* | (2006.01) |
| *C12N 15/13* | (2006.01) |
| *C07K 16/36* | (2006.01) |
| *A61P 7/02* | (2006.01) |
| *A61K 39/395* | (2006.01) |
| *C12N 9/64* | (2006.01) |

(52) U.S. Cl.
CPC ............ *C07K 16/40* (2013.01); *A61K 39/395* (2013.01); *A61P 7/02* (2018.01); *C07K 16/36* (2013.01); *C12N 9/64* (2013.01); *C07K 2317/31* (2013.01); *C07K 2317/51* (2013.01); *C07K 2317/622* (2013.01); *C07K 2317/64* (2013.01); *C07K 2317/76* (2013.01); *C07K 2317/94* (2013.01)

(58) Field of Classification Search
CPC ................................ C07K 16/40; C12N 15/00
See application file for complete search history.

(56) References Cited

U.S. PATENT DOCUMENTS

| | | | |
|---|---|---|---|
| 4,963,657 A | 10/1990 | Pixley | |
| 5,500,349 A | 3/1996 | Esnouf | |
| 6,093,399 A | 7/2000 | Thorpe et al. | |
| 8,388,959 B2 | 4/2013 | Gruber et al. | |
| 10,913,802 B2 | 2/2021 | Mason et al. | |
| 2008/0254039 A1 | 10/2008 | Nieswandt et al. | |
| 2009/0304685 A1 | 12/2009 | Pritchard | |
| 2011/0200611 A1 | 8/2011 | Sexton | |
| 2011/0201017 A1 | 8/2011 | Greenfield et al. | |
| 2012/0201756 A1* | 8/2012 | Sexton .................. | C07K 16/40 424/9.1 |
| 2014/0199361 A1 | 7/2014 | Panousis et al. | |
| 2015/0099298 A1 | 4/2015 | Wilmen et al. | |
| 2019/0002584 A1 | 1/2019 | Mason et al. | |
| 2021/0230299 A1 | 7/2021 | Mason et al. | |

FOREIGN PATENT DOCUMENTS

| | | |
|---|---|---|
| BR | 112018001202 A1 | 9/2018 |
| CN | 101180391 A | 5/2008 |
| CN | 102083971 A | 6/2011 |
| CN | 102439036 A | 5/2012 |
| CN | 103635489 A | 3/2014 |
| CN | 103687878 A | 3/2014 |
| CN | 104011221 A | 8/2014 |
| CN | 107405399 A1 | 11/2017 |
| EA | 201791527 A1 | 12/2017 |
| EP | 2 548 892 A1 | 1/2013 |
| JP | H04-503006 A | 6/1992 |
| JP | 2014-506257 A | 3/2014 |
| JP | 2014-523253 A | 9/2014 |
| JP | 2016-513682 A | 5/2016 |
| JP | 2016-525551 A | 8/2016 |

(Continued)

OTHER PUBLICATIONS

Holliger, P., et al. Engineered antibody fragments and the rise of single domains. Nature Biotechnology, 2005, 23(9):1126-1136.*
Esnouf et al., A monoclonal antibody raised against human beta-factor XIIa which also recognizes alpha-factor XIIa but not factor XII or complexes of factor XIIa with C1 esterase inhibitor. Thromb Haemost. Jun. 2000;83(6):874-81.
Kenniston et al., Inhibition of plasma kallikrein by a highly specific active site blocking antibody. J Biol Chem. Aug. 22, 2014;289(34):23596-608. doi: 10.1074/jbc.M114.569061. Epub Jun. 26, 2014.

(Continued)

*Primary Examiner* — Prema M Mertz
(74) *Attorney, Agent, or Firm* — Wolf, Greenfield & Sacks, P.C.

(57) ABSTRACT

Described herein are bispecific antibodies that bind to plasma kallikrein (pKal) and Factor XII and methods of producing and using such bi-specific antibodies for treating diseases or disorders associated with the contact system, e.g., hereditary angioedema or thrombosis.

26 Claims, 36 Drawing Sheets

Specification includes a Sequence Listing.

(56) References Cited

FOREIGN PATENT DOCUMENTS

| | | |
|---|---|---|
| JP | 2017-501968 A | 1/2017 |
| NC | 2018/0001599 A2 | 5/2018 |
| WO | WO 90/08835 A1 | 8/1990 |
| WO | WO 91/17258 A1 | 11/1991 |
| WO | WO 97/42507 A1 | 11/1997 |
| WO | WO 2006/075142 A2 | 7/2006 |
| WO | WO 2010/080623 A2 | 7/2010 |
| WO | WO 2012/094587 A1 | 7/2012 |
| WO | WO2013/014092 * | 1/2013 |
| WO | WO 2013/014092 A1 | 1/2013 |
| WO | WO 2013/014902 A1 | 1/2013 |
| WO | WO 2013/051294 A1 | 4/2013 |
| WO | WO 2014/019644 A1 | 2/2014 |
| WO | WO 2014/089493 A1 | 6/2014 |
| WO | WO 2014/113701 A1 | 7/2014 |
| WO | WO 2014/152232 A2 | 9/2014 |
| WO | WO 2014/207199 A1 | 12/2014 |
| WO | WO 2015/013671 A1 | 1/2015 |
| WO | WO 2016/109774 A1 | 7/2016 |
| WO | WO 2017/015431 A1 | 1/2017 |

OTHER PUBLICATIONS

Kontermann, Dual targeting strategies with bispecific antibodies. MAbs. Mar.-Apr. 2012;4(2): 182-97. doi: 10.4161/mabs.4.2.19000. Epub Mar. 1, 2012.

Larsson et al., A factor XIIa inhibitory antibody provides thromboprotection in extracorporeal circulation without increasing bleeding risk. Sci Transl Med. Feb. 5, 2014;6(222):222ra17. doi: 10.1126/scitranslmed.3006804.

Mason et al., Discovery and Characterization of a Highly Specific Antibody Inhibitor of Factor XIIa, and the Subsequent Generation of a Factor XIIa/Plasma Kallikrein Bispecific Antibody. Blood. Dec. 2015;126(23):2268.

He et al., Contact activation of the intrinsic coagulation pathway—a new target for anti-thrombosis research. Chinese Journal of Thrombosis and Hemostasis 2015. Abstract.

Kuo et al., Neonatal Fc receptor and IgG-based therapeutics. MAbs. Sep.-Oct. 2011;3(5):422-30. doi: 10.4161/mabs.3.5.16983. Epub Sep. 1, 2011.

Bendig, Humanization of rodent monoclonal antibodies by CDR grafting. Methods: A Companion to Methods in Enzymology. 1995:8;83-93.

Casset et al., A peptide mimetic of an anti-CD4 monoclonal antibody by rational design. Biochem Biophys Res Commun. Jul. 18, 2003;307(1):198-205. doi: 10.1016/s0006-291x(03)01131-8.

Coloma et al. Design and production of novel tetravalent bispecific antibodies. Nat Biotechnol. Feb. 1997;15(2):159-63. doi: 10.1038/nbt0297-159.

Kitazawa et al., A bispecific antibody to factors IXa and X restores factor VIII hemostatic activity in a hemophilia A model. Nat Med. Oct. 2012;18(10):1570-4. doi: 10.1038/nm.2942. Epub Sep. 30, 2012.

MacCallum et al., Antibody-antigen interactions: contact analysis and binding site topography. J Mol Biol. Oct. 11, 1996;262(5):732-45. doi: 10.1006/jmbi.1996.0548.

Orcutt et al., A modular IgG-scFv bispecific antibody topology. Protein Eng Des Sel. Apr. 2010;23(4):221-8. doi: 10.1093/protein/gzp077. Epub Dec. 17, 2009.

Paul, Chapter 9: Structure and Function of Immunoglobulins. Fundamental Immunology. 1993:3;292-5.

Rudikoff et al., Single amino acid substitution altering antigen-binding specificity. Proc Natl Acad Sci U S A. Mar. 1982;79(6):1979-83. doi: 10.1073/pnas.79.6.1979.

* cited by examiner

FIG. 2 (CONT'D)
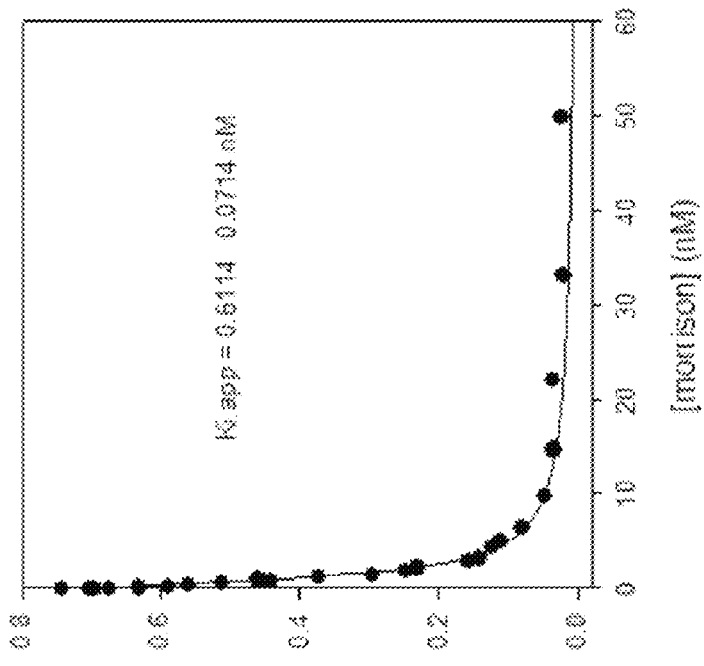
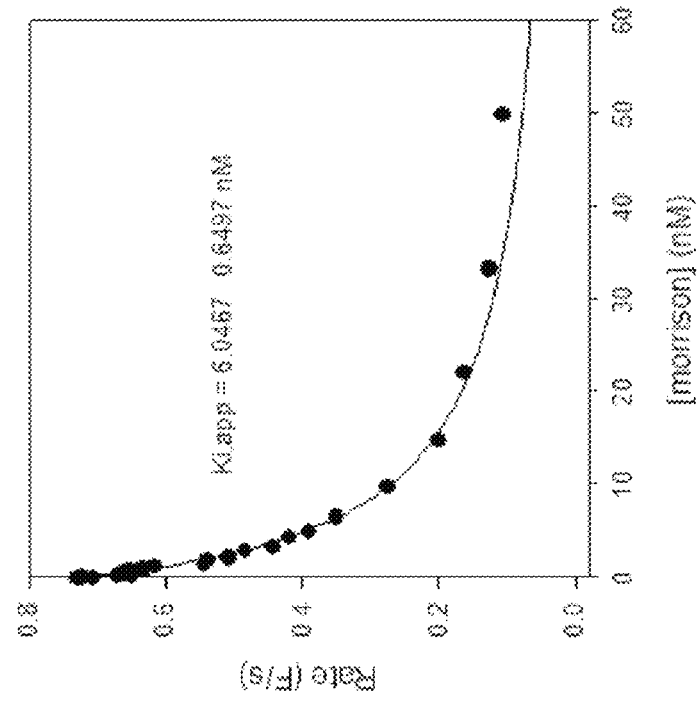

FIG. 3
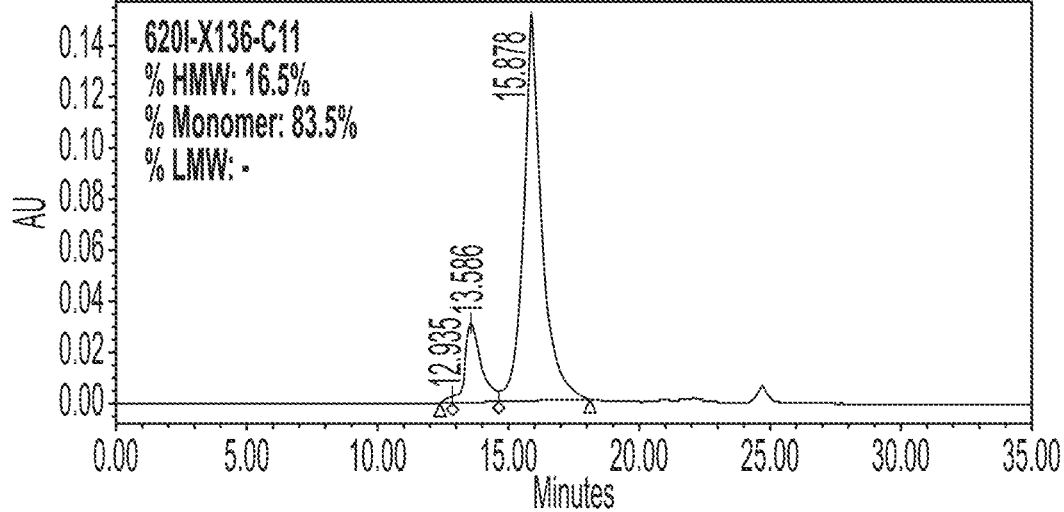
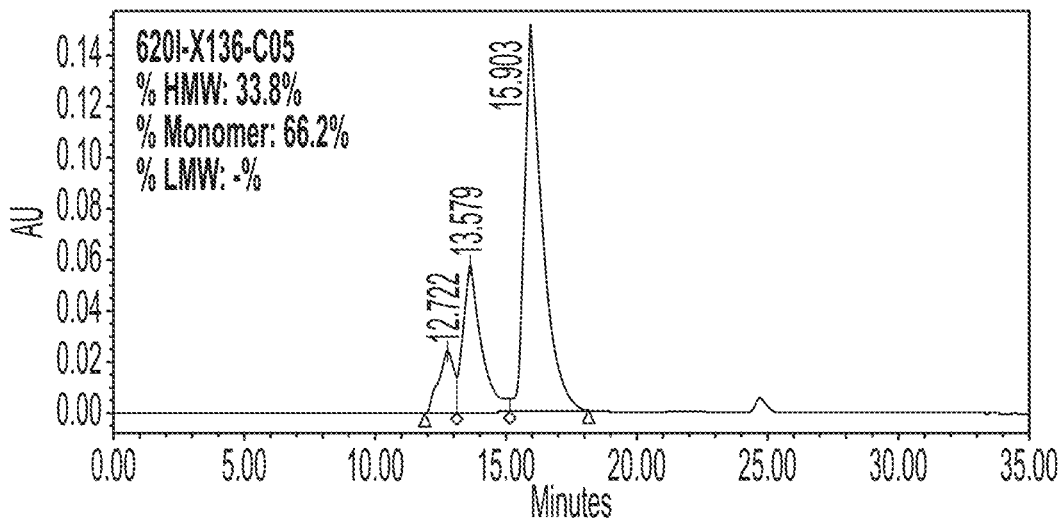
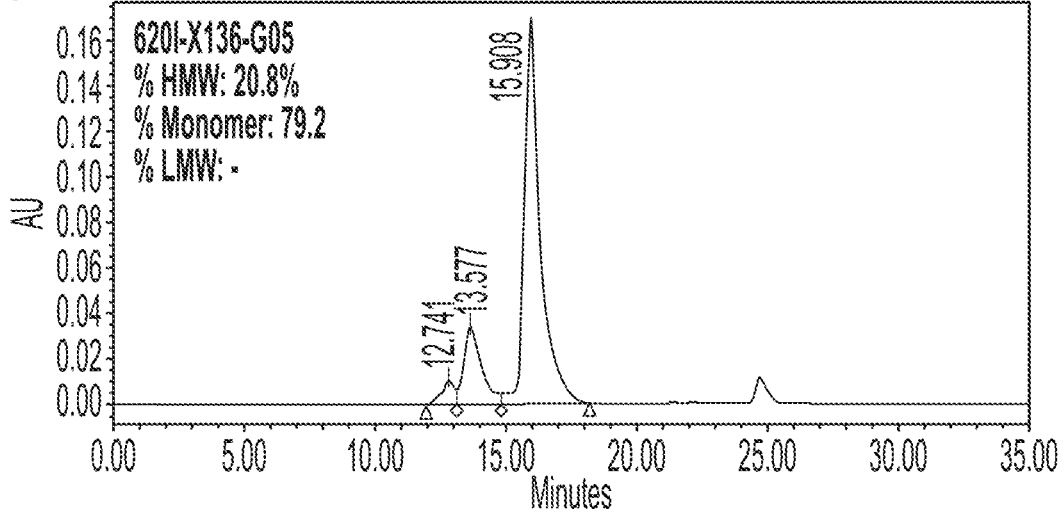

FIG. 3 (CONT'D)
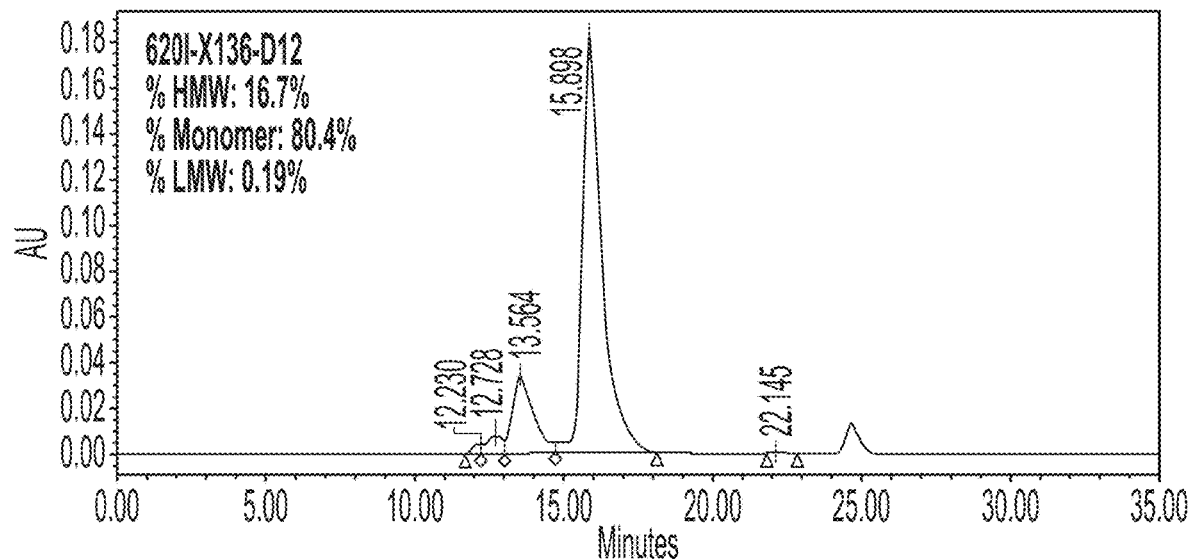
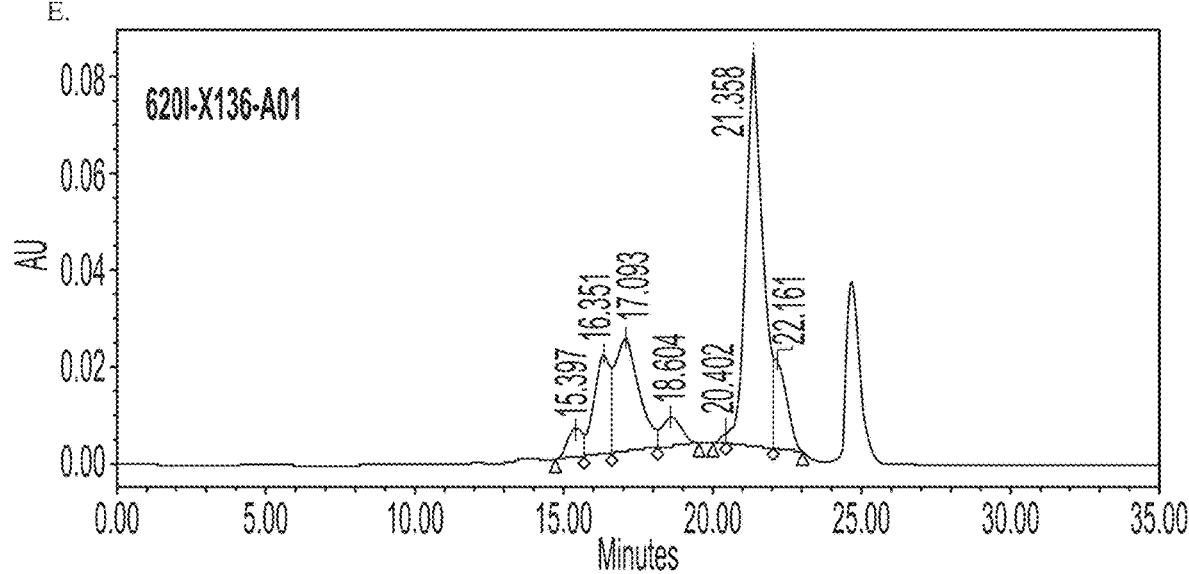

FIG. 4
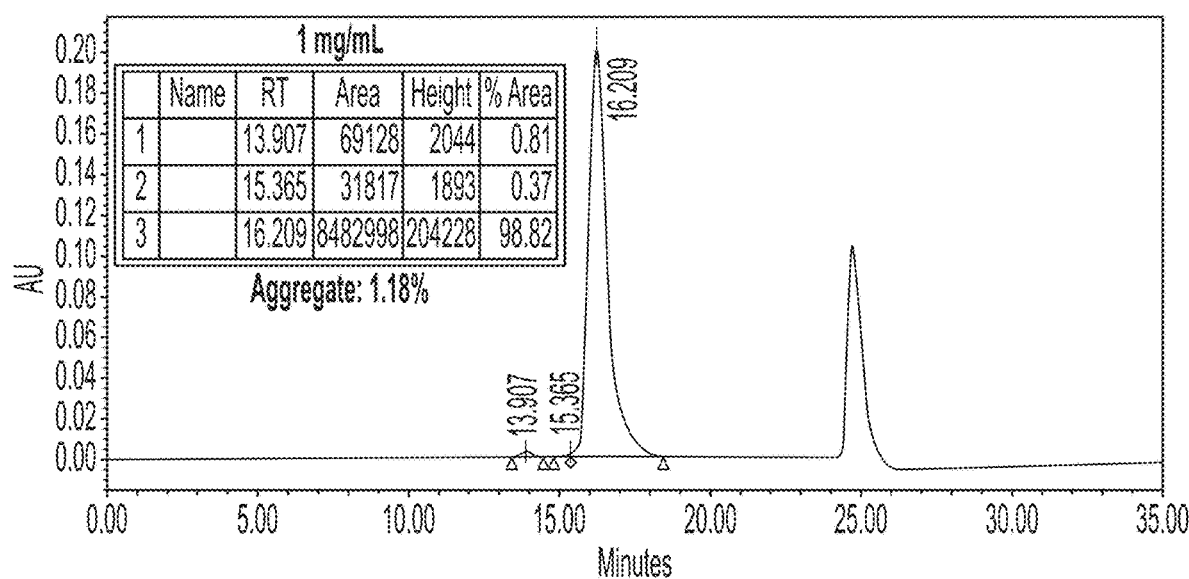
A.
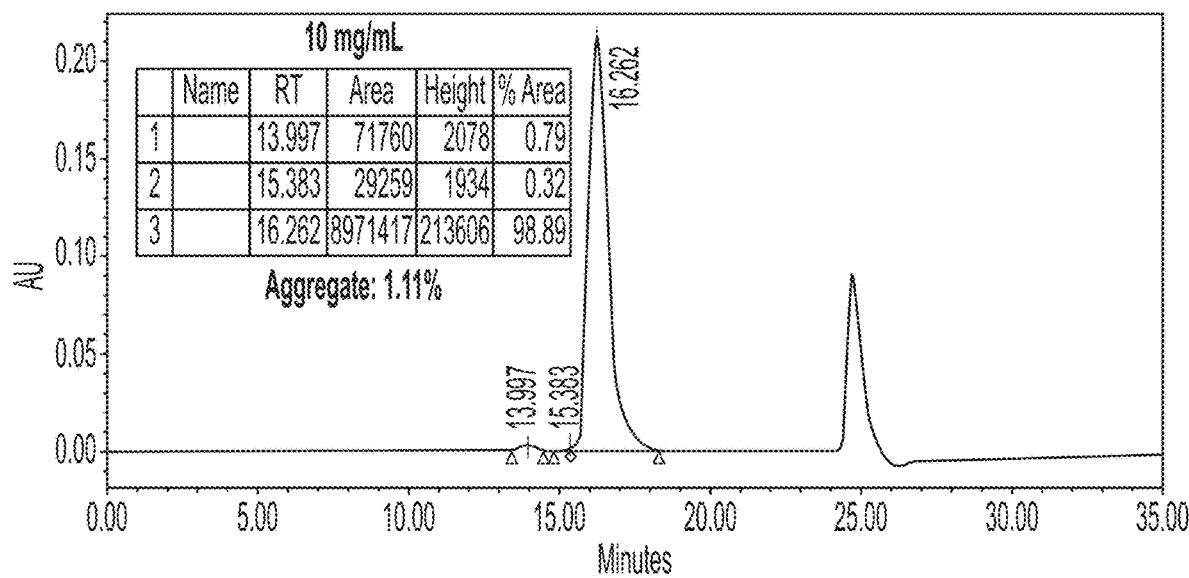
B.

FIG. 4 (CONT'D)
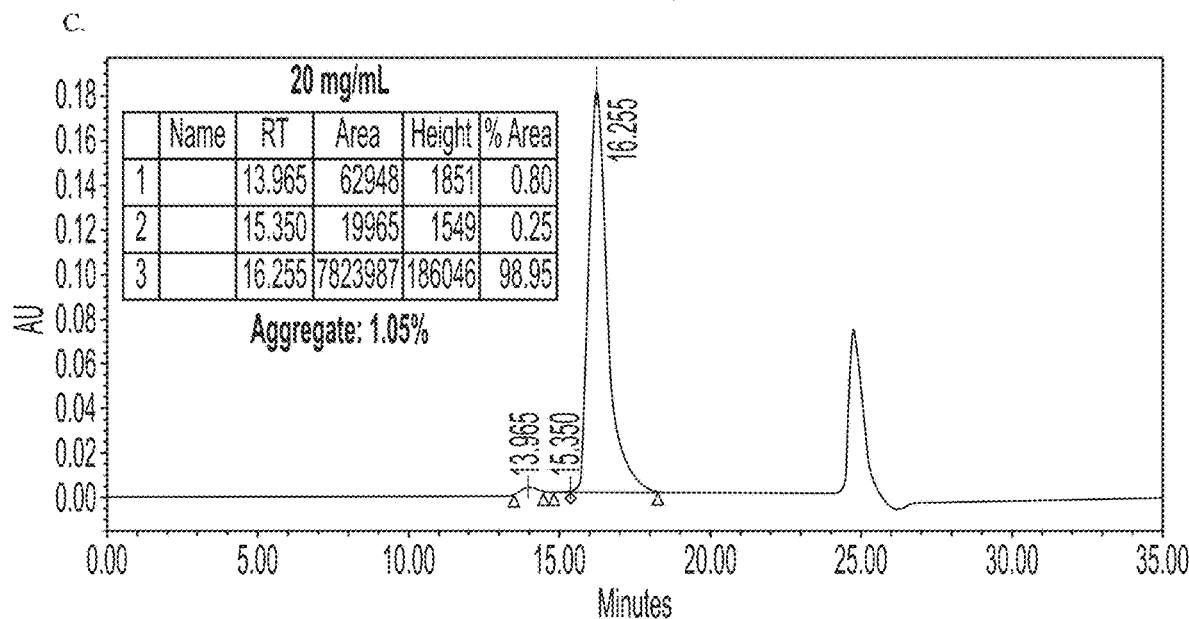
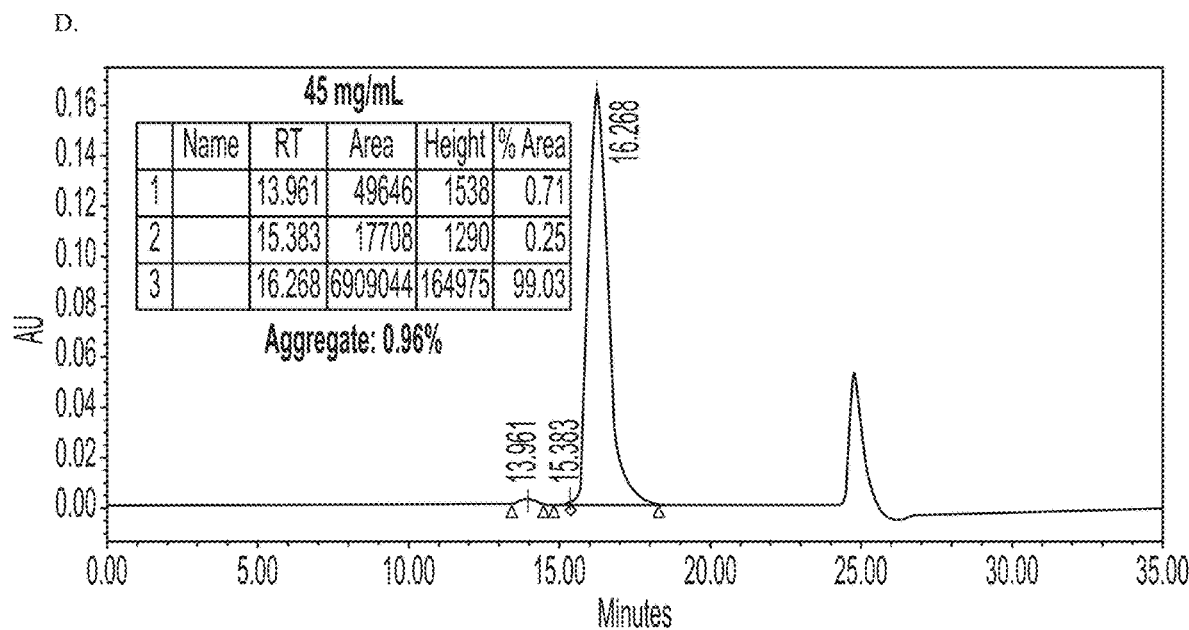

FIG. 5
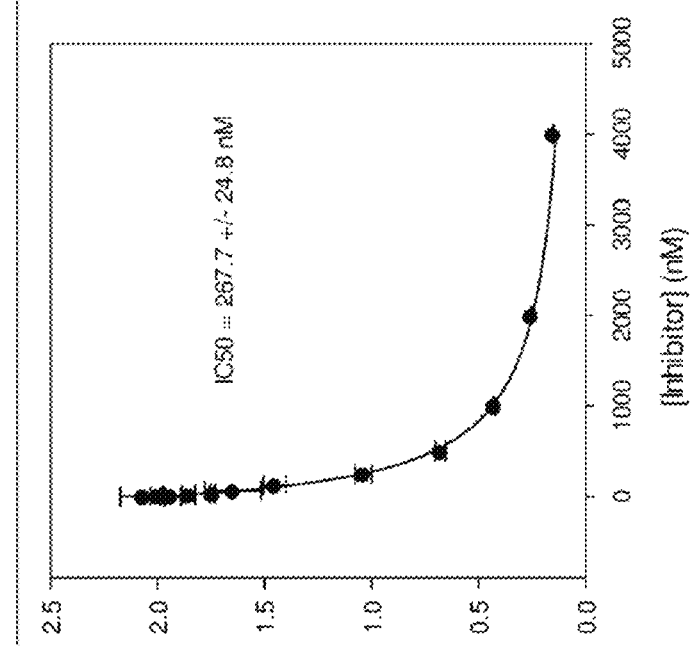
B.
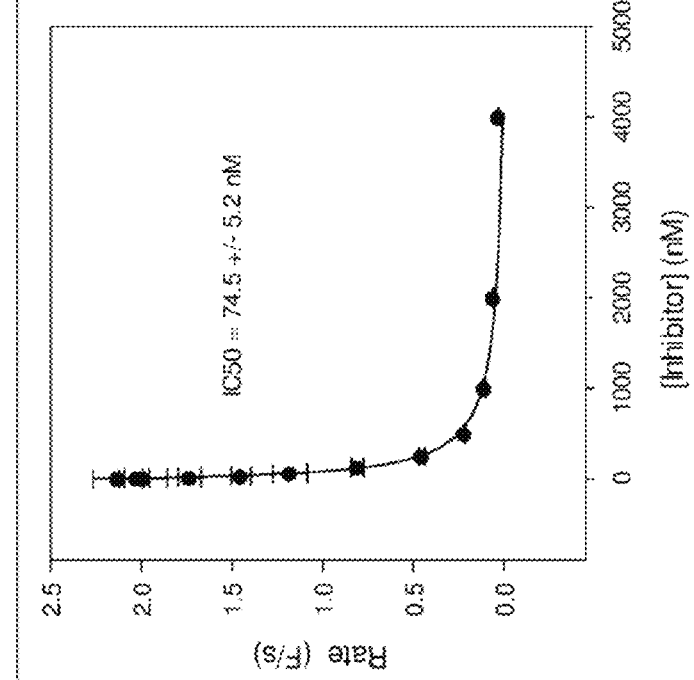
A.

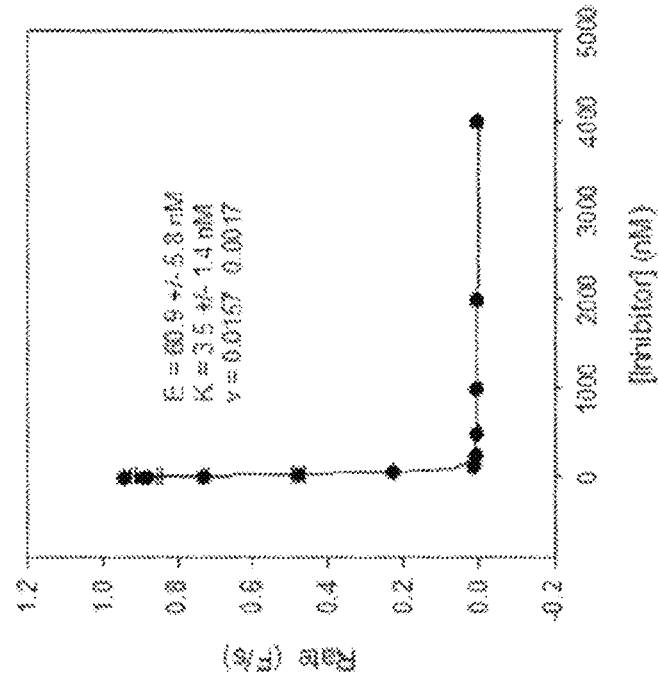
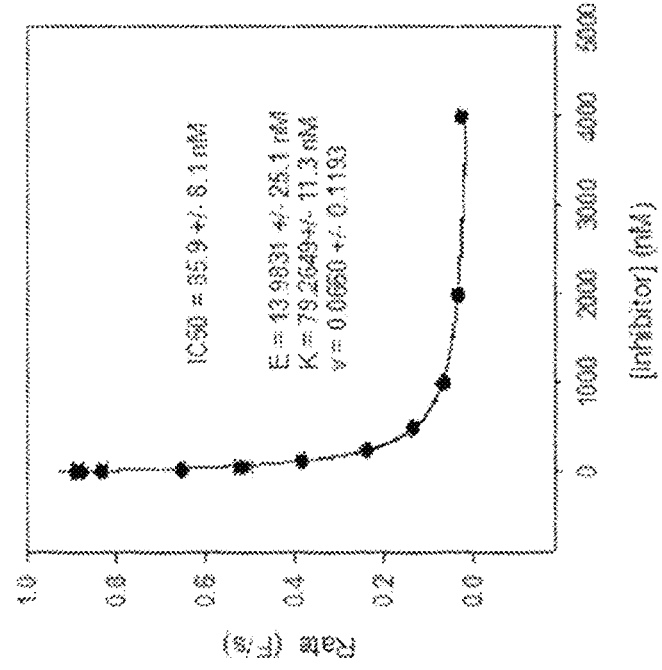
FIG. 6

FIG. 9
A.
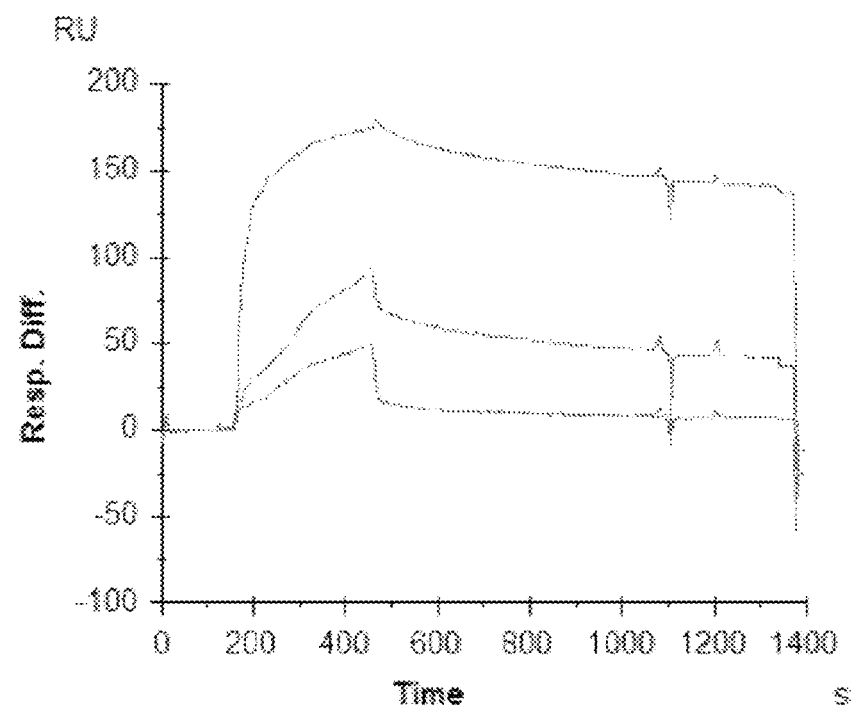
B.
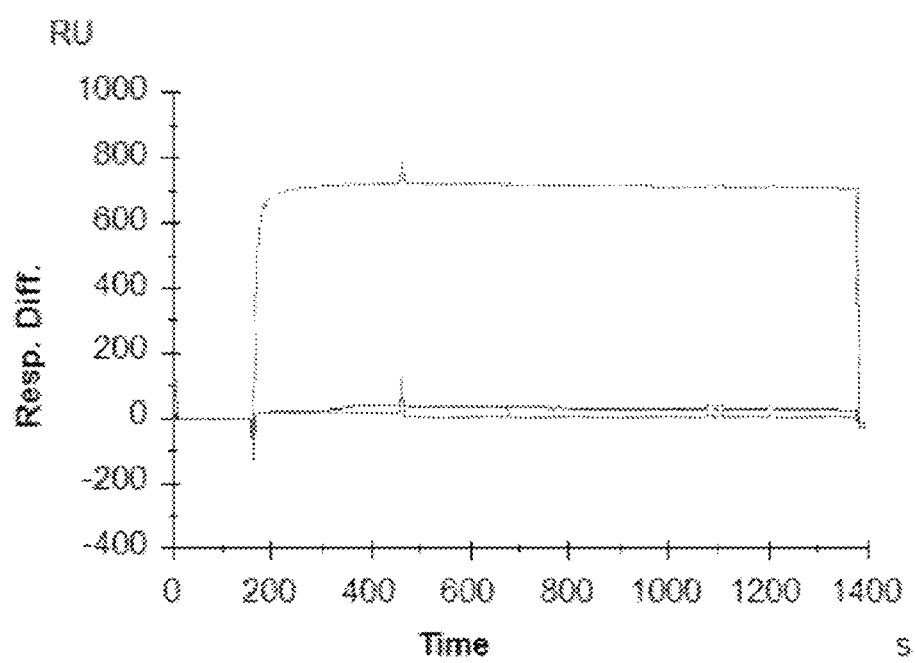

FIG. 10 (CONT'D)
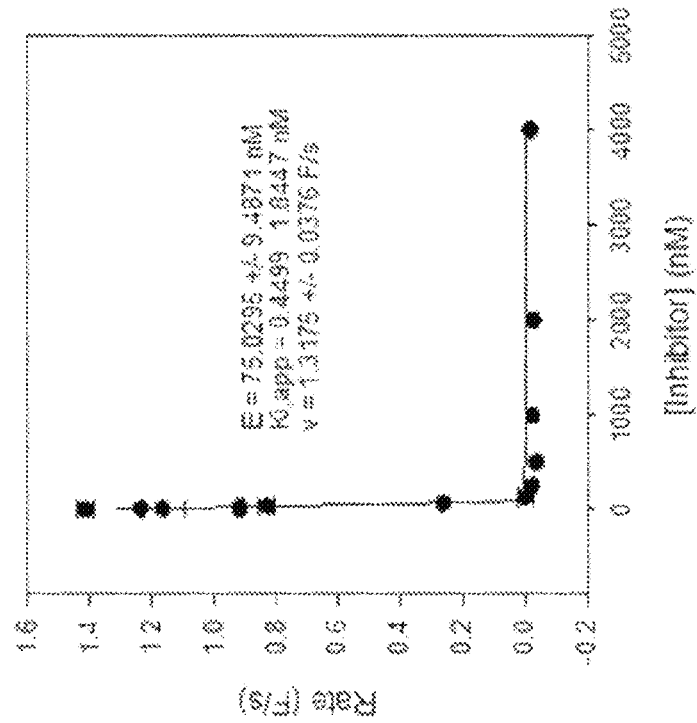
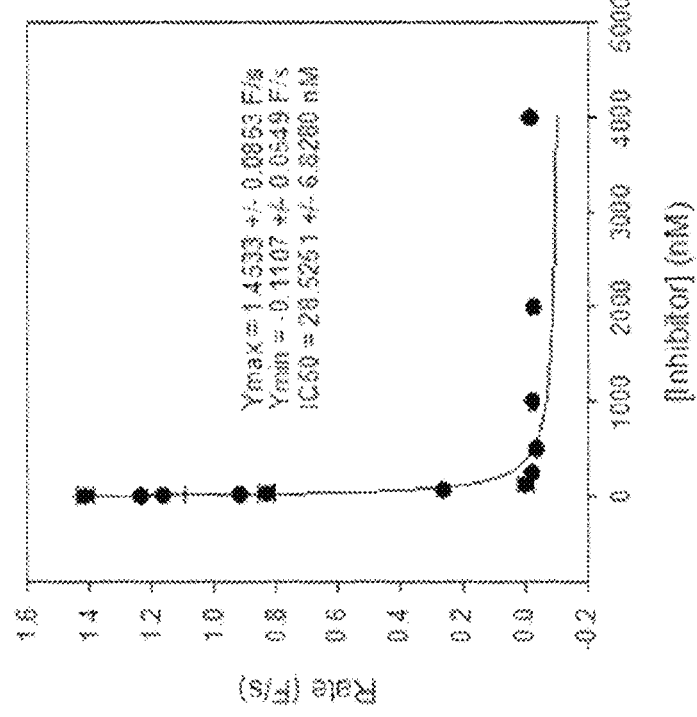

FIG. 12 (CONT'D)
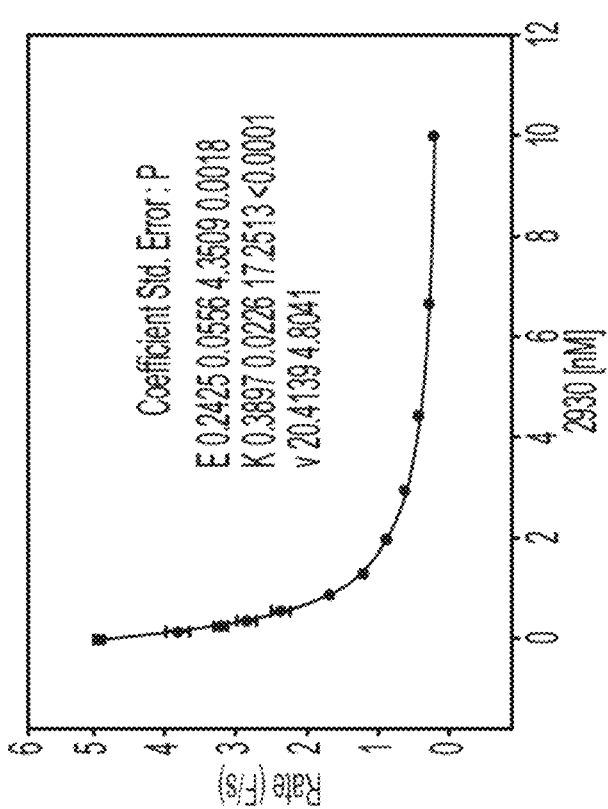
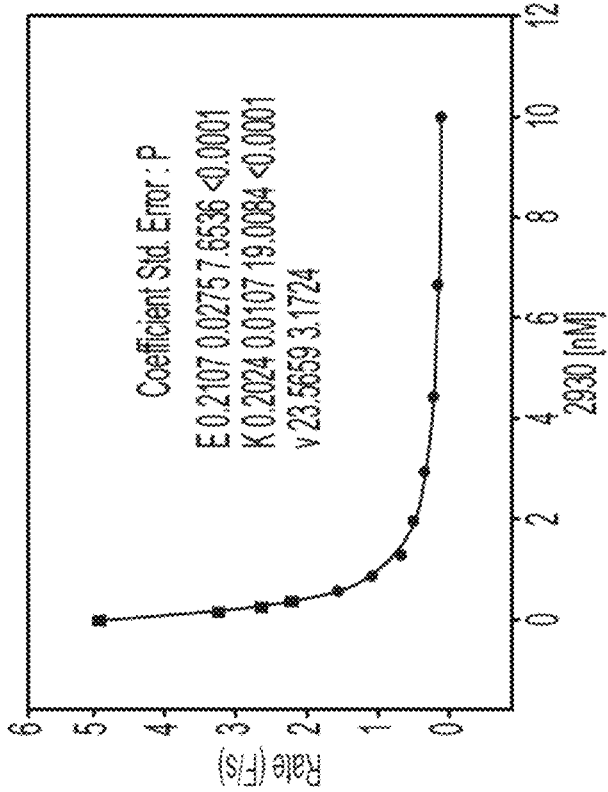
B.

FIG. 20
A.
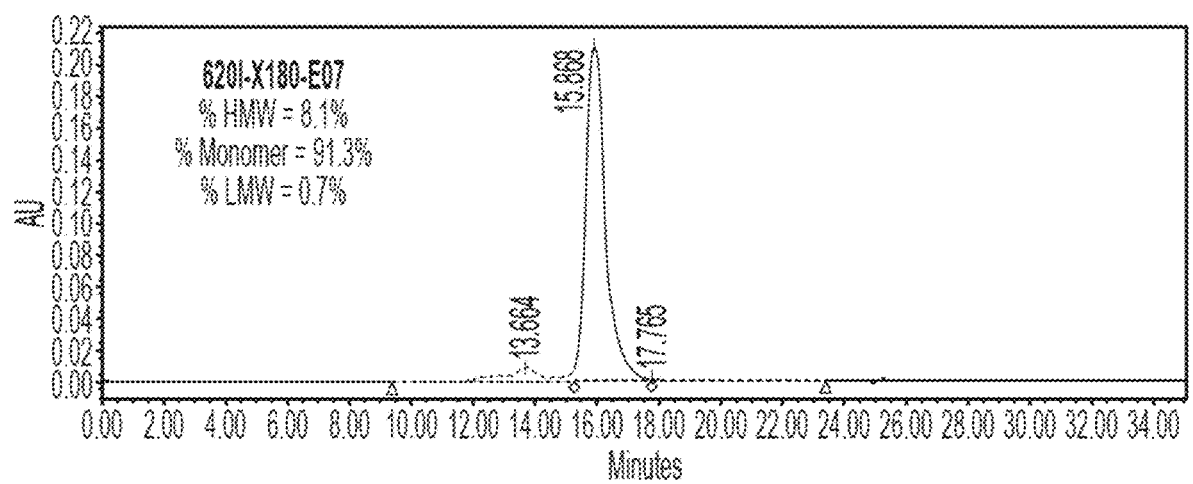
B
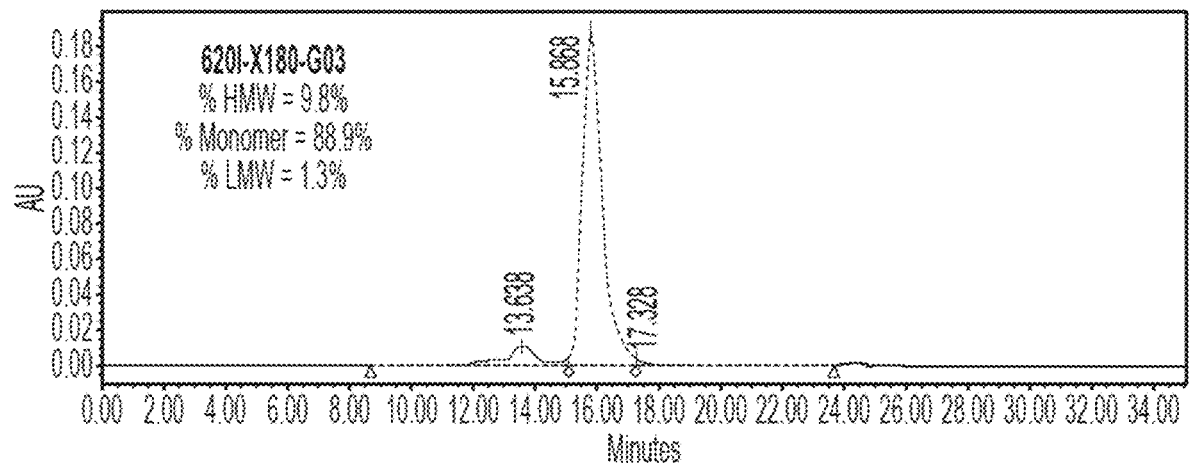

FIG. 20
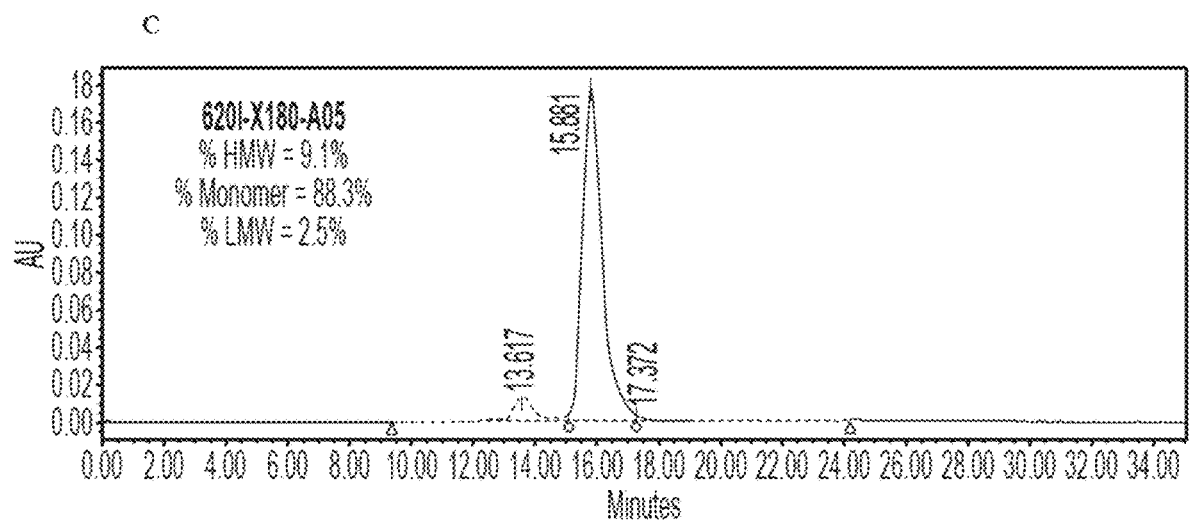
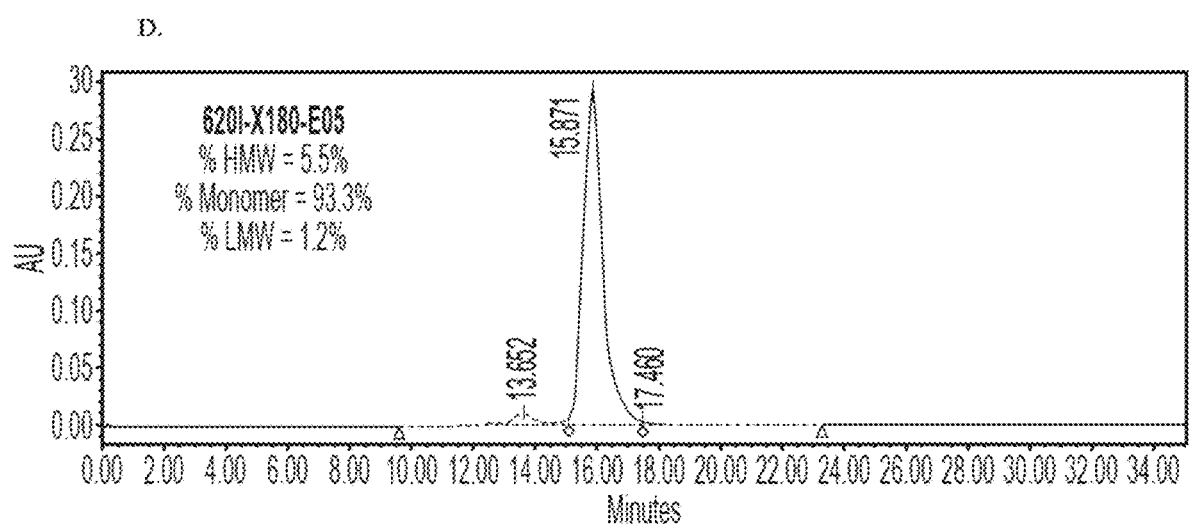

FIG. 20
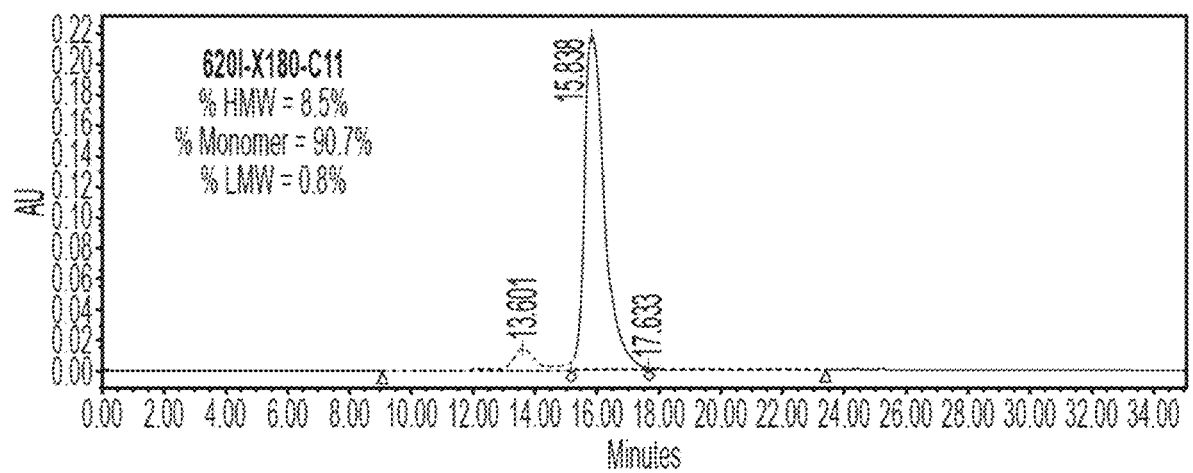
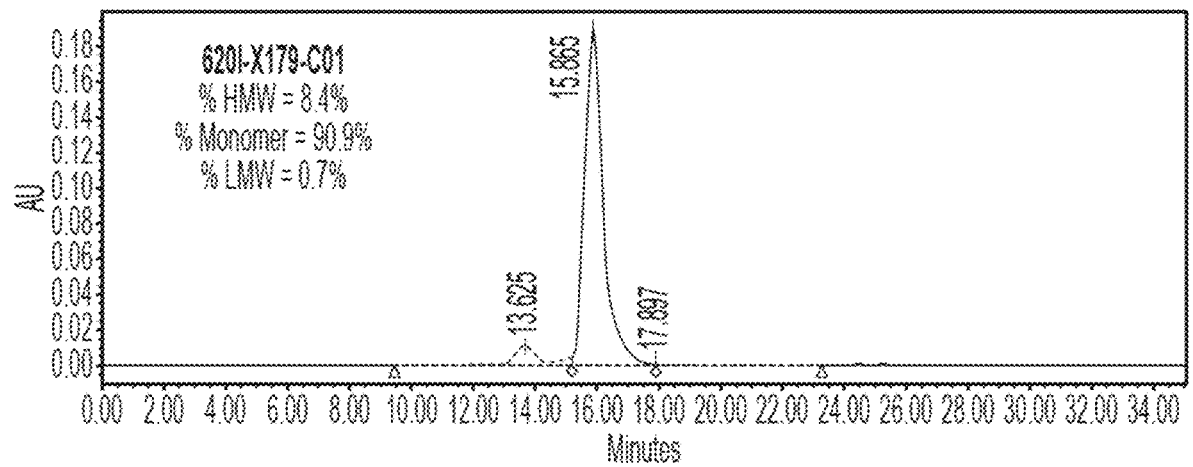

FIG. 20
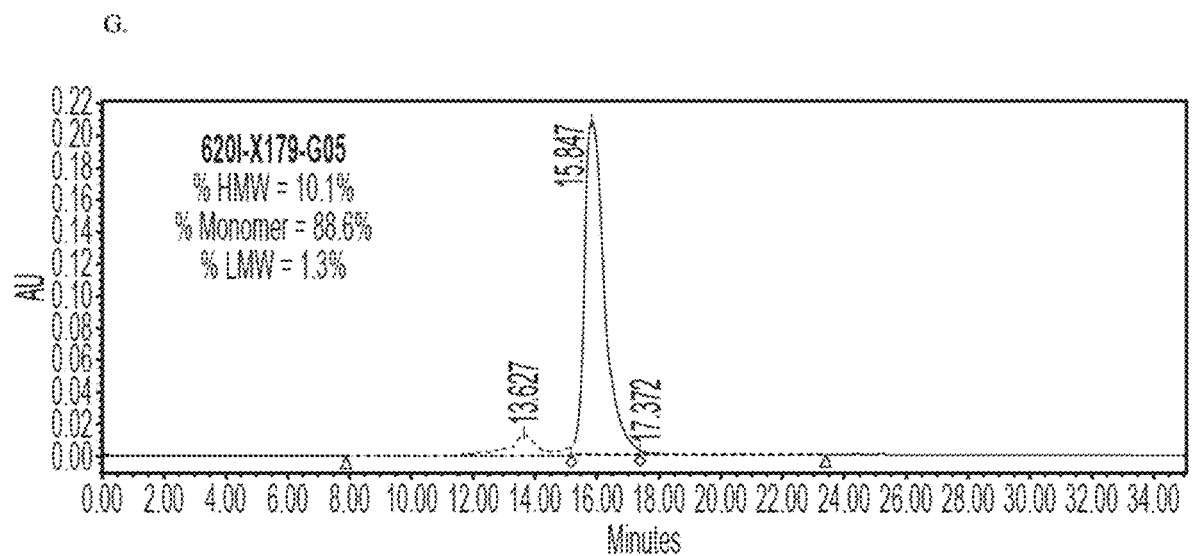
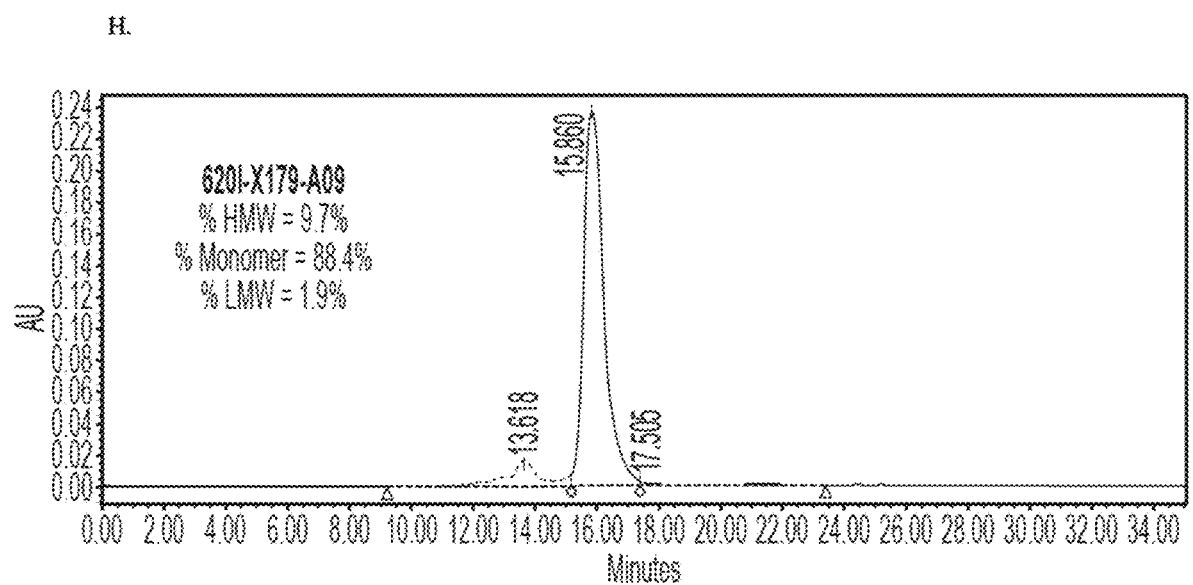

BISPECIFIC ANTIBODIES AGAINST PLASMA KALLIKREIN AND FACTOR XII

CROSS REFERENCE TO RELATED APPLICATIONS

This application claims the benefit of the filing dates of U.S. Provisional Application No. 62/099,236, filed Jan. 2, 2015, U.S. Provisional Application No. 62/200,363, filed Aug. 3, 2015, and U.S. Provisional Application No. 62/261, 609, filed Dec. 1, 2015. The entire contents of these referenced applications are incorporated by reference herein.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on May 3, 2021 is named D061770065US04-SUBSEQ-CEW.txt and is 791.966 bytes in size.

BACKGROUND OF THE INVENTION

Factor XII (FXII) is the primary activator that converts pre-kallikrein into plasma kallikrein (pKal). Activated plasma kallikrein cleaves high molecular weight kininogen (HMWK) to release bradykinin (BK). pKal can also activate latent Factor XII into active Factor XII (Factor XIIa). In disease states related to aberrant activation of the contact system, such as Hereditary Angioedema, uncontrolled levels of BK can induce patient attacks.

SUMMARY OF THE INVENTION

One aspect of the present disclosure is a bispecific antibody, comprising: a first polypeptide that comprises a light chain of a first antibody, the light chain comprising a light chain variable region ($V_L$) and a light chain constant region ($C_L$) (e.g., a kappa light chain or a lambda light chain); and a second polypeptide that comprises a heavy chain of the first antibody, the heavy chain comprising a heavy chain variable region ($V_H$) and a heavy chain constant region ($C_H$). Either the first polypeptide or the second polypeptide of the bispecific antibody further comprises a second antibody, which is a single chain antibody and can be fused to the C-terminus of either the first polypeptide or the second polypeptide. One of the first and second antibodies binds plasma kallikrein (pKal) (e.g., active pKal) and the other antibody binds Factor XII (e.g., active Factor XII or FXIIa), for example, the first antibody binds pKal and the second antibody binds FXIIa, or vice versa.

In some embodiments, the first antibody is an IgG. In one example, the IgG comprises a mutated heavy chain, which, as compared with the wild-type counterpart, has the C-terminal lysine residue deleted or mutated. For example, the mutated heavy chain of the first antibody may contain a C-terminal glycine residue, instead of a lysine residue as in a wild-type IgG heavy chain. In one example, the bispecific antibody can be tetravalent.

In some embodiments, the second polypeptide in the bispecific antibody comprises a peptide linker between the heavy chain of the first antibody and the second antibody. In one example, the peptide linker can be SGGGS (SEQ ID NO:22).

In the second antibody, which is a scFv antibody, the $V_H$ can be fused to the N-terminus of the $V_L$. Alternatively, the $V_H$ is fused to the C-terminus of the $V_L$. In some examples, the second antibody comprises a peptide linker between the $V_H$ and $V_L$ regions, e.g., a linker of $(G_4S)_4$ (SEQ ID NO:23). In some embodiments, the scFc antibody comprises a disulfide bond formed between the $V_H$ and $V_L$ chains. For example, the $V_H$ chain may contain a cysteine residue at position 44 (C44) and the $V_L$ chain may contain a cysteine residue at positon 100, wherein a disulfide bond can be formed between $C_{44}$ in the $V_H$ and $C_{100}$ in the $V_L$. In some examples, the second antibody does not contain a KR motif at its C-terminus.

In any of the bispecific antibodies described herein, the $V_H$ of the first antibody has the same complementarity determining regions (CDRs) as those in SEQ ID NO:1. In some examples, the $V_H$ of the first antibody comprises the amino acid sequence of SEQ ID NO:1. In one example, the heavy chain of the first antibody comprises the amino acid sequence of residues 20-470 of SEQ ID NO: 9. In one example, the heavy chain of the first antibody comprises the amino acid sequence of SEQ ID NO; 9, 149, or 150. Alternatively or in addition, the $V_L$ of the first antibody has the same CDRs as those in SEQ ID NO:2. In some examples, the $V_L$ of the first antibody comprises the amino acid sequence of SEQ ID NO:2.

Further, the $V_H$ of the second antibody can have the same CDRs as those in any of SEQ ID NOs:3, 4 and 123-126. In some example, the $V_H$ of the second antibody comprises any of the amino acid sequences of SEQ ID NO:3, 4 and 123-126. Alternatively or in addition, the $V_L$ of the second antibody has the same CDRs as those in any of SEQ ID NOs:5-8 and 127-130. In some examples, the $V_L$ of the second antibody comprises residues 1-111 of any one of the amino acid sequences of SEQ ID NOs:5-8 and 127 In one example, the $V_L$ of the second antibody comprises any one of the amino acid sequences of SEQ ID Nos: 5-8 and 127-130.

In some examples, the bispecific antibody described herein comprises a first polypeptide that comprises the amino acid sequence of SEQ ID NO:10 and the second polypeptide comprises any of the amino acid sequences of SEQ ID NOs: 11-20, 47-122, 141-148, and 151-158.

In another aspect, the present disclosure provides a bispecific antibody, which comprises a first antibody binding to plasma kallikrein (pKal) and a second antibody binding to Factor XII, for example, the first antibody binding to active pKal and/or the second antibody binding to active Factor XII (FXIIa). In some embodiments, the first antibody comprises a $V_H$ chain that comprises the same complementarity determining regions (CDRs) as those in SEQ ID NO:1, and/or a $V_L$ chain that comprises the same CDRs as those in SEQ ID NO:2. For example, the $V_H$ of the first antibody comprises the amino acid sequence of SEQ ID NO:1, and/or the $V_L$ of the first antibody comprises the amino acid sequence of SEQ ID NO:2.

Alternatively or in addition, the second antibody comprises a $V_H$ chain that comprises the same CDRs as those in SEQ ID NO:3 or 4, and/or a $V_L$ chain that comprises the same CDRs as those in SEQ ID NO:5, 6, 7, or 8. For example, the $V_H$ chain of the second antibody comprises the amino acid sequence of SEQ ID NO:3 or 4; and/or the $V_L$ of the second antibody comprises the amino acid sequence of SEQ ID NO:5, 6, 7, or 8.

Alternatively or in addition, the second antibody comprises a $V_H$ chain that comprises the same CDRs as those in any of SEQ ID NOs:123-126, and/or a $V_L$ chain that comprises the same CDRs as those in SEQ ID NOs:127. For example, the $V_H$ chain of the second antibody comprises the amino acid sequence of any one of SEQ ID NO: 123-126; and/or the $V_L$ of the second antibody comprises residues 1-111 of any one of the amino acid sequence of SEQ ID NO: 5-8 and 127.

In yet another aspect, the present disclosure provides an isolated nucleic acid or nucleic acid set, comprising a first nucleotide sequence encoding the first polypeptide or first antibody as described herein and a second nucleotide sequence encoding the second polypeptide or second antibody as described herein. In some embodiments, the first and second nucleotide sequences are located on two separate nucleic acid molecules (e.g., two vectors such as expression vectors). Alternatively, the first and second nucleic nucleotide sequences are located on one nucleic acid molecule (e.g., a vector such as an expression vector).

The nucleic acid or nucleic acid set described herein can be a vector set comprising a first vector that comprises the first nucleotide sequence and a second vector that comprises the second nucleotide sequence. In some examples, the first and second vectors are expression vectors, in which the first and second nucleotide sequences are in operably linkage to a promoter. In other examples, the nucleic acid described herein is a vector comprising both the first and second nucleotide sequences. Any of the vectors described herein can be an expression vector. For example, the expression vector can comprise the first and second nucleotide sequences are in operably linkage to a promoter. Also within the scope of this disclosure is a host cell comprising the vector or vector set described herein Further, the present disclosure provides compositions comprising any of the bispecific antibodies or the nucleic acid/nucleic acid sets as described herein and a pharmaceutically acceptable carrier. Such a composition can be used to treat a disease associated with the contact activation system (e.g., hereditary angioedema (HAE) or thrombosis). The treatment method described herein comprises administering to a subject in need thereof an effective amount of the pharmaceutical composition described herein. The present disclosure also provides a pharmaceutical composition for use in treating the disease as described herein, wherein the pharmaceutical composition comprises any of the bispecific antibody described herein or a nucleic acid/nucleic acid set that encodes the bispecific antibody, and a pharmaceutical acceptable carrier, and the use of such a pharmaceutical composition in manufacturing a medicament for use in treating such a disease such as HAE or thrombosis. In some embodiments, thrombosis is associated with atrial fibrillation, deep vein thrombosis (DVT), pulmonary embolism, stroke, or an arterial or venous thrombotic event.

In still another aspect, the present disclosure features a method for preparing a bispecific antibody, the method comprising: (a) culturing the host cell or host cell set as described herein under conditions allowing for expression of the first polypeptide and the second polypeptide; and (b) isolating the bispecific antibody that comprises the first polypeptide and the second polypeptide. In some examples, the host cell comprises an expression vector comprising a first nucleotide sequence encoding the first polypeptide and a second nucleotide sequence encoding the second polypeptide.

The details of one or more embodiments of the disclosure are set forth in the description below. Other features or advantages of the present disclosure will be apparent from the following drawings and detailed description of several embodiments, and also from the appended claims.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein.

FIG. 3 includes graphs showing the analytical size exclusion chromatography (SEC) traces of 5 exemplary bispecific molecules. The front peak shows that these clones have a high molecular weight aggregate, ranging from % HMW 16.5-33.8. A: 620I-X136-C11. B: 620I-X136-005. C: 620I-X136-G05. D: 620I-X136-D12. E: 620I-X136-A01.

FIG. 4 includes graphs showing reduction of high molecular weight aggregate for 620I-X0173-A11 (620I-X0136-D12 with H44/L100 engineered disulfide bond) across a range of concentrations. A: 620I-X0173-A11 at 1 mg/mL. B: 620I-X0173-A11 at 10 mg/mL. C: 620I-X0173-A11 at 20 mg/ml. D: 620I-X0173-A11 at 45 mg/ml.

FIG. 9 includes graphs showing biacore binding of 620I-X0173-A11 (620I-X0136-D12 with disulfides) against pKal (Top sensorgram) and FXIIa (Bottom sensorgram). A: pKal binding (top curve) is higher than blank surface (middle) and pre-Kallikrein (bottom). Original FXIIa isolates showed non-specific binding to the biacore chip, which explains the Ss binding signals seen for pre-Kal and blanks. B: FXIIa binding (top curve) is demonstrably higher than FXII (bottom) and blank (middle).

FIG. 20 includes graphs showing the analytical size exclusion chromatography (SEC) traces of re-engineered bispecific antibodies after 48 hours at room temperature at pH=7.5. A: 620I-X180-E07. B: 620I-X180-G03. C: 620I-X180-A05. D: 620I-X180-E06. E: 620I-X180-C11. F: 620I-X179-001. G: 620I-X179-G05. H: 620I-X179-A09.

DETAILED DESCRIPTION OF THE INVENTION

Figure 1:
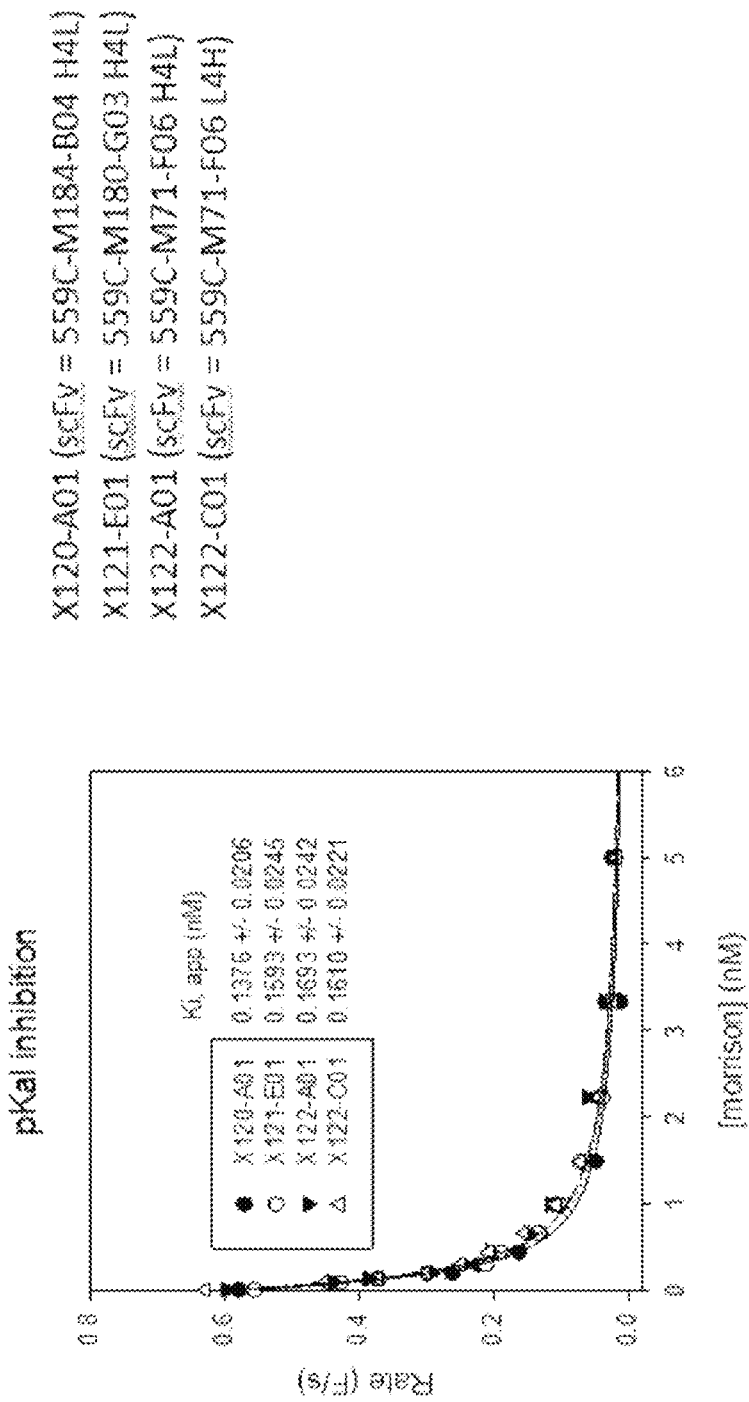
FIG. 1 is a graph showing the activity of various bispecific antibody clones for inhibiting pKal, including clones X120-A01 (scFv=559C-M184-B04 H4L), X121-E01 (scFv=559C-M184-G03 H4L), X122-A01 (scFv=559C-M71-F06 H4L), and X122-001 (scFv=559C-M71-F06 L4H).

The contact activation system initiates the intrinsic pathway of coagulation through the release of the proinflammatory peptide bradykinin (BK). BK release is facilitated by a series of enzyme activation steps in the contact activation system. Factor XIIa (FXIIa) converts pre-kallikrein to plasma kallikrein (pKal). Activated pKal then cleaves high molecular weight kininogen (HMWK) to release bradykinin (BK). Importantly, pKal can also activate latent Factor XII to produce additional active Factor XIIa. It is believed that a positive feedback loop is formed, with pKal activating FXII to FXIIa, and FXIIa activating pre-kallikrein to pKal.

In diseases associated with the contact activation system, such as hereditary angioedema (HAE) or thrombosis, uncontrolled levels of BK can induce inflammatory responses, such as patient HAE attacks. Accordingly, agents for controlling the levels of BK, e.g., inhibitors of pKal and FXII, may have important therapeutic value.

Described herein are bispecific antibodies that bind to both pKal and FXII, e.g., active pKal and/or FXIIa, and uses thereof in inhibiting both pKal and FXII and treating diseases associated with the contact activation system, such as hereditary angioedema (HAE) and thrombosis. As shown in Examples below, a number of exemplary bispecific antibodies as described herein were shown to inhibit both pKal and FXIIa activities. Without wishing to be bound by theory, the bispecific antibodies described herein are expected to exhibit superior therapeutic effects in treating diseases associated with contact activation system, as compared to agents that can inhibit either pKal or FXII, because the bispecific antibodies can inhibit the activity of both pKal and FXII, thereby reducing the BK levels synergistically via, e.g., blocking the positive feedback loop between pKal and FXII.

Bispecific Antibodies Binding to pKal and FXII

As used herein, an antibody (interchangeably used in plural form) is an immunoglobulin molecule, or a functional fragment thereof, that is capable of binding to a target antigen, such as a carbohydrate, polynucleotide, lipid, or polypeptide, through at least one antigen recognition site located in the variable region of the immunoglobulin molecule. A multispecific antibody. e.g., a bispecific antibody, is an immunoglobulin molecule or a functional fragment/ variant thereof, that is capable of binding to multiple target antigens, e.g., two antigens or two epitopes of one antigen. The bispecific antibodies described herein can bind to both plasma kallikrein (pKal) and Factor XII. In some embodiments, the bispecific antibodies can bind to and inhibit both active pKal and FXIIa.

Antigen, as used herein, refers to any molecule (e.g., protein, nucleic acid, polysaccharide, or lipid) that has the ability to generate antibodies. An epitope is a portion of an antigen (e.g., a portion of pKal or FXII) to which an antibody binds. Epitopes usually consist of chemically active (such as polar, non-polar or hydrophobic) surface groupings of moieties such as amino acids or polysaccharide side chains and can have specific three-dimensional structural characteristics, as well as specific charge characteristics. An epitope can be linear in nature or can be a discontinuous epitope, e.g., a conformational epitope, which is formed by a spatial relationship between non-contiguous amino acids of an antigen rather than a linear series of amino acids. A conformational epitope includes epitopes resulting from folding of an antigen, where amino acids from differing portions of the linear sequence of the antigen come in close proximity in 3-dimensional space.

The bispecific antibody described herein comprises two antibody portions, a first antibody portion binding to pKal (e.g., active pKal) and a second antibody portion binding to FXII (e.g., FXIIa). The first and second antibodies portions can be derived from two parent antibodies capable of binding to the desired antigens, i.e., pKal (e.g., active pKal) and FXII (e.g., FXIIa). One or both of the parent antibodies for constructing the bispecific antibodies as described herein can be naturally occurring antibodies (e.g., an antibody derived from a suitable donor such as human, mouse, rat, rabbit, horse, or sheep), genetically engineered antibodies (e.g., humanized antibodies, chimeric antibodies), or antibodies derived from a natural or synthetic antibody library. In some embodiments, one parent antibody is an IgG antibody, e.g., an IgG antibody binding to pKal such as DX-2930 or an IgG antibody binding to FXIIa, and the other parent antibody is a scFv antibody, e.g., a scFv antibody binding to FXIIa such as the anti-FXIIa clones described herein or an scFv antibody binding to pKal.

The heavy chain of a naturally occurring IgG molecule typically contains a lysine residue at the C-terminus. In some embodiments, this C-terminal lysine residue can be either deleted or mutated, e.g., to a glycine residue, in the bispecific antibodies disclosed herein. Alternatively or in addition, the KR motif, which typically presents at the junction of a light chain variable region and a light chain constant region, can be deleted from the light chain of the first antibody, the second antibody, or both, in the bispecific antibodies described herein. In some examples, the KR motif is deleted from the scFv portion (e.g., at the C-terminus of the scFv) of any of the bispecific antibodies described herein. These mutations may reduce proteolytic cleavage and/or improve expression, production, and/or manufacture of the bispecific antibody.

In some examples, at least one parent antibody can be an affinity matured antibody, which refers to an antibody having one or more modifications in one or more CDRs or framework regions (FRs) as compared to the unmodified parent antibody, leading to an improvement in the affinity of the antibody for the target antigen. Preferred affinity matured antibodies may have nanomolar or even picomolar affinities for the target antigen. Affinity maturation of an antibody can be performed by various methods known in the art, including by variable domain shuffling (see, e.g., Marks et al. 1992, Bio/Technology 10:779-783), random mutagenesis of CDR and/or FR residues (see, e.g., Barbas et al., 1994, Proc Nat. Acad. Sci, USA 91:3809-3813; Schier et al., 1995, Gene 169:147-155; Yelton et al., 1995, J. Immunol. 155: 1994-2004; Jackson et al., 1995, J. Immunol. 154(7):3310-9; and Hawkins et al, 1992, J. Mol. Biol. 226:889-896). The parent antibodies can be of any class, such as IgD, IgE, IgG, IgA, or IgM, or a sub-class thereof, or a single chain antibody, such as a scFv.

Each antibody portion in the bispecific antibody as described herein can be an antibody in any form, including, but not limited to, intact (i.e., full-length) antibodies, antigen-binding fragments thereof (such as Fab, Fab', F(ab)$_2$, Fv), single chain antibodies (scFv antibodies), and tetravalent antibodies. In some embodiments, the bispecific antibody is tetravalent, which comprises two binding sites for pKal and two binding sites for FXII.

In some embodiments, the anti-pKal portion, the anti-FXII portion, or both in the bispecific antibodies described herein specifically bind to the corresponding target antigen or an epitope thereof. An antibody that "specifically binds" to an antigen or an epitope is a term well understood in the art, and methods to determine such specific binding are also well known in the art. A molecule is said to exhibit "specific binding" if it reacts or associates more frequently, more rapidly, with greater duration and/or with greater affinity with a particular target antigen than it does with alternative targets. An antibody "specifically binds" to a target antigen or epitope if it binds with greater affinity, avidity, more readily, and/or with greater duration than it binds to other substances. For example, an antibody that specifically (or preferentially) binds to an antigen (e.g., human pKal or FXII) or an antigenic epitope therein is an antibody that binds this target antigen with greater affinity, avidity, more readily, and/or with greater duration than it binds to other antigens or other epitopes in the same antigen. It is also understood by reading this definition that, for example, an antibody that specifically binds to a first target antigen may or may not specifically or preferentially bind to a second target antigen. As such, "specific binding" or "preferential binding" does not necessarily require (although it can include) exclusive binding. Generally, but not necessarily, reference to binding means preferential binding. In some examples, an antibody that "specifically hinds" to a target antigen or an epitope thereof may not hind to other antigens or other epitopes in the same antigen. In some embodiments, the bispecific antibody described herein specifically binds to both active pKal and FXIIa.

In some embodiments, a bispecific antibody as described herein has a suitable binding affinity for one or both of the target antigens (e.g., pKal or FXIIa) or antigenic epitopes thereof. As used herein, "binding affinity" refers to the apparent association constant or $K_A$. The $K_A$ is the reciprocal of the dissociation constant ($K_D$). The bispecific antibody described herein may have a binding affinity ($K_D$) of at least $10^{-5}$, $10^{-6}$, $10^{-7}$, $10^{-8}$, $10^{-9}$, $10^{-10}$ M, or lower for one or both of the target antigens or antigenic epitopes. An increased binding affinity corresponds to a decreased K. Higher affinity binding of an antibody for a first antigen and a second antigen relative to a third antigen can be indicated by a higher $K_A$ (or a smaller numerical value $K_D$) for binding the first antigen and second antigen than the $K_A$ (or numerical value $K_D$) for binding the third antigen. In such cases, the antibody has specificity for the first antigen and second antigen (e.g., a first protein in a first conformation or mimic thereof and a second protein in a first conformation or mimic thereof) relative to the third antigen (e.g., the same first or second protein in a second conformation or mimic thereof; or a third protein). Differences in binding affinity (e.g., for specificity or other comparisons) can be at least 1.5, 2, 3, 4, 5, 10, 15, 20, 37.5, 50, 70, 80, 91, 100, 500, 1000, 10,000 or $10^5$ fold.

Binding affinity (or binding specificity) can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in HBS-P buffer (10 mM HEPES pH7.4, 150 mM NaCl, 0.005% (v/v) Surfactant P20). These techniques can be used to measure the concentration of bound binding protein as a function of target protein concentration. The concentration of bound binding protein ([Bound]) is related to the concentration of free target protein ([Free]) and the concentration of binding sites for the binding protein on the target where (N) is the number of binding sites per target molecule by the following equation:

[Bound]=[N][Free]/(Kd+[Free])

It is not always necessary to make an exact determination of $K_A$, though, since sometimes it is sufficient to obtain a quantitative measurement of affinity, e.g., determined using a method such as ELISA or FACS analysis, is proportional to $K_A$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

(i) Anti-pKal Portion

Any antibody capable of binding to pKal, such as active pKal, can be used in constructing the bispecific antibodies described herein. In some examples, the anti-pKal antibody portion in the bispecific antibody can bind to human pKal and inhibits its activity by at least 50% (e.g., 60%, 70%, 80%, 90%, 95% or greater). The inhibition constant (Ki) provides a measure of inhibitor potency; it is the concentration of inhibitor required to reduce enzyme activity by half and is not dependent on enzyme or substrate concentrations. The inhibitory activity of an anti-pKal antibody portion in the bispecific antibody described herein can be determined by routine methods. In some examples, the bispecific antibody as described herein has an anti-pKal $K_{i,app}$ value lower than 1 nM, e.g., 0.5 nM, 0.2 nM, 0.1 nM, 0.09 nM, 0.08 nM, 0.07 nM, 0.06 nM, 0.05 nM, 0.04 nM, 0.03 nM, 0.02 nM, 0.01 nM, or lower. The $K_{i,app}$ value of an antibody can be estimated following the methods known in the art.

In some embodiments, the anti-pKal portion of the bispecific antibody can interact with one or more of the following residues: V410, L412, T413, A414, Q415, R416, L418, C419. H434, C435. F436, D437, G438, L439, W445, Y475, K476, V477, 5478, E479, G480, D483, F524, E527, K528, Y552, D554, Y555, A564, D572, A573, C574, K575, G576, 5578, T596, 5597, W598, G599, E600, G601, C602, A603, R604, Q607, P608, G609, V610, and Y611 in human pKal. The amino acid sequence of the C-terminal fragment of human pKal that encompasses the involved amino acid residues (boldfaced and underlined) is shown below (SEQ ID NO:21):

```
391-IVGGTNSSWG EWPWQVSLQV KLTAQRHLCG GSLIGHQWVL

TAAHCFDGLP LQDVWRIYSG ILNLSDITKD TPFSQIKEII

IHQNYKVSEG NHDIALIKLQ APLNYTEFQK PISLPSKGDT

STIYTNCWVT GWGFSKEKGE IQNILQKVNI PLVTNEECQK

RYQDYKITQR MVCAGYKEGG KDACKGDSGG PLVCKHNGMW

RLVGITSWGE GCARREQPGV YTKVAEYMDW ILEKTQSSDG

KAQMQSPA-638
```

In some examples, the anti-PKal antibody portion can bind an epitope of the pKal, the epitope comprising one of the following segments in SEQ ID NO:21 shown above: V410-C419. H434-L439, Y475-G480, F524-K528, Y552-Y555, D572-S578, T596-R604, or Q607-Y611.

In one example, the anti-pKal portion of the bispecific antibody described herein is derived from antibody DX-2930, which is described in US 20120201756 (incorporated by reference herein). The heavy chain variable region and light chain variable region of DX-2930, as well as the full-length heavy chain and light chain of this antibody, are provided below (CDR regions: boldfaced and underlined; signal sequences: italic). The heavy chain CDR1-3 sequences correspond to SEQ ID NOs: 159-161, respectively, and the light chain CDR1-3 sequences correspond to SEQ ID NOs: 162-164.

```
Heavy chain variable region of DX-2930 (SEQ ID NO:
1):
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSS

Light chain variable region of DX-2930 (SEQ ID NO:
2):
DIQMTQSPSTLSASVGDRVTITCRASQSISSWLAWYQQKPGKAPKLLIYK

ASTLESGVPSRFSGSGSGTEFTLTISSLQPDDFATYYCQQYNTYWTFGQG

TKVEIK

DX-2930 heavy chain (SEQ ID NO: 9)
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDKTHTC

PPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYPSD

IAVEWESNGQPENNYKTTPPVLDSDGSFFLYSKLTVDKSRWQQGNVFSCS

VMHEALHNHYTQKSLSLSPGK

DX-2930 light chain (SEQ ID NO: 10)
MGWSCIILFLVATATGVHSDIQMTQSPSTLSASVGDRVTITCRASQSISS

WLAWYQQKPGKAPKLLIYKASTLESGVPSRFSGSGSGTEFTLTISSLQPD

DFATYYCQQYNTYWTFGQGTKVEIKRTVAAPSVFIFPPSDEQLKSGTASV
```

```
VCLLNNFYPREAKVQWKVDNALQSGNSQESVTEQDSKDSTYSLSSTLTLS

KADYEKHKVYACEVTHQGLSSPVTKSFNRGEC
```

In some examples, the anti-pKal portion of the bispecific antibody comprises a heavy chain variable region that comprises an amino acid sequence at least 80% (e.g., 85%, 90%, 95%, or 98%) identical to SEQ ID NO:1 and/or a light chain variable region that comprises an amino acid sequence at least 80% (e.g., 85%, 90%, 95%, or 98%) identical to SEQ ID NO:2. The "percent identity" of two amino acid sequences is determined using the algorithm of Karlin and Altschul *Proc. Natl. Acad. Sci.* USA 87:2264-68, 1990, modified as in Karlin and Altschul *Proc. Natl. Acad. Sci.* USA 90:5873-77, 1993. Such an algorithm is incorporated into the NBLAST and XBLAST programs (*version* 2.0) of Altschul, et al. *J. Mol. Biol.* 215:403-10, 1990. BLAST protein searches can be performed with the XBLAST program, score=50, wordlength=3 to obtain amino acid sequences homologous to the protein molecules of interest. Where gaps exist between two sequences, Gapped BLAST can be utilized as described in Altschul et al., *Nucleic Acids Res.* 25(17):3389-3402, 1997. When utilizing BLAST and Gapped BLAST programs, the default parameters of the respective programs (e.g., XBLAST and NBLAST) can be used.

In other examples, the anti-pKal portion in the bispecific antibody as described herein comprises a heavy chain variable region that comprises the same three CDRs as those in SEQ ID NO:1, and/or the same three CDRs as those in SEQ ID NO:2. Two heavy chain variable regions (or two light chain variable regions) having the same CDRs means that the CDRs in the two heavy chain variable regions (or light chain variable regions) as determined by the same numbering scheme are identical. Exemplary numbering schemes for determining antibody CDRs include the "Kabat" numbering scheme (Kabat et al. (1991), 5th Ed. Public Health Service, National Institutes of Health, Bethesda, Md.), the "Chothia" numbering scheme (Al-Lazikani et al., (1997) JMB 273, 927-948), the "Contact" numbering scheme (MacCallum et al., J. Mol. Biol. 262:732-745 (1996)), the "IMGT" numbering scheme (Lefranc M P et al., Dev Comp Immunol, 2003 January; 27(1):55-77), and the "AHo" numbering scheme (Honegger A and Pluckthun A, J Mol Biol, 2001 Jun. 8; 309(3):657-70). As known to those skilled in the art, the CDR regions of the exemplary anti-pKal and anti-FXII antibodies identified herein are determined by the "Chothia" numbering scheme, which is used as an example.

Alternatively, the anti-pKal portion can include one or more (e.g., up to 2, 3, 4, 5, 6, 7, or 8) mutations in one or more of the CDRs as compared to SEQ ID NO:1 and/or SEQ ID NO:2. Such mutations can be conservative amino acid substitutions. As used herein, a "conservative amino acid substitution" refers to an amino acid substitution that does not alter the relative charge or size characteristics of the protein in which the amino acid substitution is made. Conservative substitutions of amino acids include substitutions made amongst amino acids within the following groups: (a) M, I, L, V; (b) F, Y. W; (c) K. R, H; (d) A. G; (e) S, T; (f) Q, N; and (g) E, D.

In any of the examples described herein, the anti-pKal portion of the bispecific antibody may comprise one or more (e.g., 1, 2, 3, 4, 5, or more) mutations or deletions as compared with a reference antibody. Such mutations may be introduced, for example to reduce proteolytic cleavage of the bispecific antibody, and/or to improve expression, production, and/or manufacture of the bispecific antibody. In some embodiments, the anti-pKal portion of the bispecific antibody is an IgG and the heavy chain of the IgG has the C-terminal lysine residue removed or mutated as compared with its wild-type counterpart. In some embodiments, the IgG heavy chain C-terminal lysine is mutated to a neutral amino acid residue, for example, a glycine residue or an alanine residue.

Example sequences of such mutated heavy chains of the anti-pKal portion of a bispecific antibody are provided below (using the heavy chain of DX-2930 as an example).

DX-2930 heavy chain including deletion of
C-terminal lysine residue
                                          (SEQ ID NO: 149)
```
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDKTHTC

PPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYPSD

IAVEWESNGQPENNYKTTPPVLDSDGSFFLYSKLTVDKSRWQQGNVFSCS

VMHEALHNHYTQKSLSLSPG
```

DX-2930 heavy chain including mutation of
C-terminal lysine to glycine
                                          (SEQ ID NO: 150)
```
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDKTHTC

PPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYPSD

IAVEWESNGQPENNYKTTPPVLDSDGSFFLYSKLTVDKSRWQQGNVFSCS

VMHEALHNHYTQKSLSLSPGG
```

The italicized portions of the sequences provided above refer to the signal peptides. The anti-pKal portion of the bispecific antibody disclosed herein may include the same signal peptides, may have the signal peptides removed or replaced with a different signal peptide. Signal peptides for use in producing secretory proteins are well known in the art.

The anti-pKal portion in the bispecific antibody can be in any antibody form, including, but not limited to, intact (i.e., full-length) antibodies, antigen-binding fragments thereof (such as Fab, Fab', F(ab')$_2$, Fv), and single chain antibodies. In some examples, the heavy chain variable region of the anti-pKal portion as described herein is linked to a heavy chain constant region ($C_H$), which can be the full-length of a heavy chain constant region or a portion thereof (e.g., $C_H1$, $C_H2$, $C_H3$, or a combination thereof). The heavy chain constant region can be derived from any $C_H$ known in the art. In some embodiments, the $C_H$ is a gamma heavy chain. Alternatively or in addition, the light chain variable region of the anti-pKal portion is linked to a light chain constant region ($C_L$), which can be any $C_L$ known in the art. In some examples, the $C_L$ is a kappa light chain. In other examples, the $C_L$ is a lambda light chain. Antibody heavy and light chain constant regions are well known in the art, e.g., those provided in the IMGT database (www.imgt.org) or at www.vbase2.org/vbstat.php., both of which are incorporated by reference herein. In some examples, the anti-pKal portion is an IgG, which can comprise the same heavy chain as DX-2930 (SEQ ID NO:9) and/or the same light chain as DX-2930 (SEQ ID NO:10).

Alternatively, the anti-pKal portion in the bispecific antibody as described herein can be a single-chain antibody (ScFv), in which a heavy chain variable region and light chain variable region are fused, e.g., via a peptide linker such as the linker of (GGGGS)$_4$ (SEQ ID NO:23). In one example, the heavy chain variable region and light chain variable region are fused in an H→L orientation. In another example, the heavy chain variable region and light chain variable region are fused in an L→H orientation. In some embodiments, the light chain portion of the ScFv does not contain a Lys-Arg (KR) motif at its C-terminus.

In one example, the anti-pKal portion in the bispecific antibody described herein is DX-2930 (an IgG antibody) described herein, which comprises a heavy chain of SEQ ID NO:9 and a light chain of SEQ ID NO:10, or an antigen-binding fragment thereof.

(ii) Anti-FXII Portion

Any antibody capable of binding to FXII, such as active FXII (FXIIa), can be used in constructing the bispecific antibodies described herein. In some examples, the anti-FXII antibody portion in the bispecific antibody can bind to human FXIIa and inhibits its activity by at least 50% (e.g., 60%, 70%, 80%, 90%, 95% or greater). The inhibitory activity of the anti-FXII antibody portion in the bispecific antibody described herein can be determined by routine methods. In some examples, the bispecific antibody as described herein has an anti-FXIIa $K_i^{app}$ value lower than 1 nM, e.g., 0.5 nM, 0.2 nM, 0.1 nM, 0.09 nM, 0.08 nM, 0.07 nM, 0.06 nM, 0.05 nM, 0.04 nM, 0.03 nM, 0.02 nM, 0.01 nM, or lower. The $K_{i,app}$ value of an antibody can be estimated following the methods known in the art.

In some example, the anti-FXII portion of the bispecific antibody described herein is derived from anti-FXII clones 559C-M0071-F06, 559C-M0179-D04, 559C-M0181-C02, 559C-M0180-G03, and 559C-M0184-B04. The heavy chain variable regions and light chain variable regions of these clones are provided below (CDRs in boldface and underlined):

```
Heavy chain variable region of clones
559C-M0071-F06, 559C-M0179-D04, 559C-M0181-C02,
and 559C-M0180-G03 (SEQ ID NO: 3):
EVQLLESGGGLVQPGGSLRLSCAASGFTFSGYIMAWVRQAPGKGLEWVSY

IYPSGGITVYADSVKGRFTISRDNSKNTLYLQMNSLRAEDTAVYYCTRQR

YRGPKYYYYMDVWGKGTTVTVSS

Heavy chain variable region of clone 559C-M0184-
B04
(SEQ ID NO: 4):
EVQLLESGGGLVQPGGSLRLSCAASGFTFSFYSMHWVRQAPGKGLEWVSR

IYPSGGVTKYADSVKGRFTISRDNSKNTLYLQMNSLRAEDTAVYYCTRQR

YRGPKYYYYMDVWGKGTTVTVSS

Light chain variable region of clones
559C-M0071-F06 and 559C-M0184-B04 (SEQ ID NO: 5):
DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

Light chain variable region of clone
559C-M0179-D04 (SEQ ID NO: 6):
DIQMTQSPLSLSVAPGEPASISCRSSQSLLHRNGHNYLDWYLQKPGQSPQ

LLIYLGSNRASGVPERFSGSGSGTDFTLRISRVEAEDVGVYYCMQALQAR

TFGQGTKVEIKR

Light chain variable region of clone
559C-M0181-C02 (SEQ ID NO: 7):
DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTR

TFGQGTKVEIKR

Light chain variable region of clone
559C-M0180-G03 (SEQ ID NO: 8):
DIQMTQSPLSLPVTPGEPASISCRSSQSLLHSNGYNYLDWYLQKPGQSPQ

IMIYLGSNRASGVPDRFSGSGSGTDFTLKISRVEAEDVGVYYCMQALQTP

RTFGQGTKVEIKR

Heavy chain variable region of clone
620I-X0173-A11 (620I-X0177-A01) (SEQ ID NO: 123)
EVQLLESGGGLVQPGGSLRLSCAASGFTFSQYVMHWVRQAPGKCLEWVSS

IWPSGGHTRYADSVKGRFTISRDNSKNTLYLQMNSLRAEDTAVYYCARQR

YRGPKYYYYMDVWGQGTTVTVSS

Heavy chain variable region of clone
620I-X0173-C07 (620I-X0177-C01) (SEQ ID NO: 124)
EVQLLESGGGLVQPGGSLRLSCAASGFTFSWYVMHWVRQAPGKCLEWVSS

IYPSGGKTSYADSVKGRFTISRDNSKNTLYLQMNSLRAEDTAVYYCARQR

YRGPKYYYYMDVWGQGTTVTVSS

Heavy chain variable region of clone
620I-X0173-E07 (620I-X0177-E01) (SEQ ID NO: 125)
EVQLLESGGGLVQPGGSLRLSCAASGFTFSWYSMHWVRQAPGKCLEWVSV

IYPSGGKTRYADSVKGRFTISRDNSKNTLYLQMNSLRAEDTAVYYCARQR

YRGPKYYYYMDVWGQGTTVTVSS

Heavy chain variable region of clone
620I-X0173-G11 (620I-X0177-G01) (SEQ ID NO: 126)
EVQLLESGGGLVQPGGSLRLSCAASGFTFSHYVMHWVRQAPGKCLEWVSS

IYPSGGLTKYADSVKGRFTISRDNSKNTLYLQMNSLRAEDTAVYYCARQR

YRGPKYYYYMDVWGQGTTVTVSS

Light chain variable region of clone
620I-X0173-A11 (SEQ ID NO: 127)
DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

Light chain variable region of clone
620I-X0173-C07 (SEQ ID NO: 128)
DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR
```

-continued

Light chain variable region of clone
620I-X0173-E07 (SEQ ID NO: 129)
DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

Light chain variable region of clone
620I-X0173-G11 (SEQ ID NO: 130)
DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

The light chain variable regions of clones 620I-X0173-A11 (SEQ ID No:127), 620I-X0173-007 (SEQ ID NO: 128), 620I-X0173-E07 (SEQ ID NO: 129), and 620I-X0173-G11 (SEQ ID NO: 130) are identical.

In some examples, the anti-FXIIa portion of the bispecific antibody comprises a heavy chain variable region that comprises an amino acid sequence at least 80% (e.g., 85%, 90%, 95%, or 98%) identical to SEQ ID NO:3 or SEQ ID NO:4, and/or a light chain variable region that comprises an amino acid sequence at least 80% (e.g., 85%, 90%, 95%, or 98%) identical to any of SEQ ID NOs:5-8. For example, the heavy chain variable region can comprise an amino acid sequence at least 80% (e.g., 85%, 90%, 95%, or 98%) identical to SEQ ID NO:3 and the light chain variable region can comprise an amino acid sequence at least 80% (e.g., 85%, 90%, 95%, or 98%) identical to any of SEQ ID NOs:5-8. Alternatively, the heavy chain variable region can comprise an amino acid sequence at least 80% (e.g., 85%, 90%, 95%, or 98%) identical to SEQ ID NO:4 and the light chain variable region can comprise an amino acid sequence at least 80% (e.g., 85%, 90%, 95%, or 98%) identical to SEQ ID NO:5.

In some examples, the anti-FXIIa portion of the bispecific antibody comprises a heavy chain variable region that comprises an amino acid sequence at least 80% (e.g., 85%, 90%. 95%, or 98%) identical to any of SEQ ID NOs: 123-126, and/or a light chain variable region that comprises an amino acid sequence at least 80% (e.g., 85%, 90%, 95%, or 98%) identical to any of SEQ ID NOs:127-130. For example, the heavy chain variable region can comprise an amino acid sequence at least 80% (e.g., 85%, 90%, 95%, or 98%) identical to SEQ ID NO:123 and the light chain variable region can comprise an amino acid sequence at least 80% (e.g., 85%, 90%, 95%, or 98%) identical to SEQ ID NO: 127. Alternatively, the heavy chain variable region can comprise an amino acid sequence at least 80% (e.g., 85%, 90%, 95%, or 98%) identical to SEQ ID NO:124 and the light chain variable region can comprise an amino acid sequence at least 80% (e.g., 85%, 90%, 95%, or 98%) identical to SEQ ID NO: 128. Alternatively, the heavy chain variable region can comprise an amino acid sequence at least 80% (e.g., 85%, 90%, 95%, or 98%) identical to SEQ ID NO:125 and the light chain variable region can comprise an amino acid sequence at least 80% (e.g., 85%, 90%, 95%, or 98%) identical to SEQ ID NO: 129. Alternatively, the heavy chain variable region can comprise an amino acid sequence at least 80% (e.g., 85%, 90%, 95%, or 98%) identical to SEQ ID NO:126 and the light chain variable region can comprise an amino acid sequence at least 80% (e.g., 85%, 90%, 95%, or 98%) identical to SEQ ID NO: 130.

In other examples, the anti-FXIIa portion in the bispecific antibody as described herein comprises a heavy chain variable region and/or a light chain variable region that comprises the same three CDRs as those in clones 559C-M0071-F06, 559C-M0179-D04, 559C-M0181-C02, 559C-M0180-G03, 559C-M0184-B04, 620I-X0173-A11, 620I-X0173-007, 620I-X0173-E07, or 620I-X0173-G11, and/or the same three CDRs as those in these clones. See Table 1 below:

TABLE 1

CDR Sequences of Anti-FXIIa Clones:

| Clones | LCDR1 | LCDR2 | LCDR3 | HCDR1 | HCDR2 | HCDR3 |
|---|---|---|---|---|---|---|
| 559C-M0071-F06 | RSSQSLLHSNGYNYLD (SEQ ID NO: 34) SEQ ID NO: 5 | LGSNRAS (SEQ ID NO: 36) | MQALQTPWT (SEQ ID NO: 37) | GYIMA (SEQ ID NO: 41) SEQ ID NO: 3 | YIYPSGGITVYADSVKG (SEQ ID NO: 43) | QRYRGPKYYYYMDV (SEQ ID NO: 45) |
| 559C-M0179-D04 | RSSQSLLHRNGHNYLD (SEQ ID NO: 35) SEQ ID NO: 6 | LGSNRAS (SEQ ID NO: 36) | MQALQART (SEQ ID NO: 38) | GYIMA (SEQ ID NO: 41) SEQ ID NO: 3 | YIYPSGGITVYADSVKG (SEQ ID NO: 43) | QRYRGPKYYYYMDV (SEQ ID NO: 45) |
| 559C-M0181-C02 | RSSQSLLHSNGYNYLD (SEQ ID NO: 34) SEQ ID NO: 7 | LGSNRAS (SEQ ID NO: 36) | MQALQTRT (SEQ ID NO: 39) | GYIMA (SEQ ID NO: 41) SEQ ID NO: 3 | YIYPSGGITVYADSVKG (SEQ ID NO: 43) | QRYRGPKYYYYMDV (SEQ ID NO: 45) |
| 559C-M0180-G03 | RSSQSLLHSNGYNYLD (SEQ ID NO: 34) SEQ ID NO: 8 | LGSNRAS (SEQ ID NO: 36) | MQALQTPRT (SEQ ID NO: 40) | GYIMA (SEQ ID NO: 41) SEQ ID NO: 3 | YIYPSGGITVYADSVKG (SEQ ID NO: 43) | QRYRGPKYYYYMDV (SEQ ID NO: 45) |
| 559C-M0184-B04 | RSSQSLLHSNGYNYLD (SEQ ID NO: 34) SEQ ID NO: 8 | LGSNRAS (SEQ ID NO: 36) | MQALQTPWT (SEQ ID NO: 37) | FYSMH (SEQ ID NO: 42) SEQ ID NO: 4 | RIYPSGGVTKYADSVKG (SEQ ID NO: 44) | QRYRGPKYYYYMDV (SEQ ID NO: 45) |

TABLE 1-continued

CDR Sequences of Anti-FXIIa Clones:

| Clones | LCDR1 | LCDR2 | LCDR3 | HCDR1 | HCDR2 | HCDR3 |
|---|---|---|---|---|---|---|
| 620I-X0173-A11 | RSSQSLLHSNGYNYLD (SEQ ID NO: 131) SEQ ID NO: 123 | LGSNRAS (SEQ ID NO: 36) | MQALQTPWT (SEQ ID NO: 37) | QYVMH (SEQ ID NO: 132) SEQ ID NO: 127 | SIWPSGGHTRYADSVKG (SEQ ID NO: 133) | QRYRGPKYYYMDV (SEQ ID NO: 134) |
| 620I-X0173-C07 | RSSQSLLHSNGYNYLD (SEQ ID NO: 131) SEQ ID NO: 124 | LGSNRAS (SEQ ID NO: 36) | MQALQTPWT (SEQ ID NO: 37) | WYVMH (SEQ ID NO: 135) SEQ ID NO: 128 | SIYPSGGKTSYADSVKG (SEQ ID NO: 136) | QRYRGPKYYYMDV (SEQ ID NO: 134) |
| 620I-X0173-E07 | RSSQSLLHSNGYNYLD (SEQ ID NO: 131) SEQ ID NO: 131 | LGSNRAS (SEQ ID NO: 36) | MQALQTPWT (SEQ ID NO: 37) | WYSMH (SEQ ID NO: 137) | VIYPSGGKTRYADSVKG (SEQ ID NO: 138) | QRYRGPKYYYMDV (SEQ ID NO: 134) |
| 620I-X0173-G11 | RSSQSLLHSNGYNYLD (SEQ ID NO: 131) | LGSNRAS (SEQ ID NO: 36) | MQALQTPWT (SEQ ID NO: 37) | HYVMH (SEQ ID NO: 139) | SIYPSGGLTKYADSVKG (SEQ ID NO: 140) | QRYRGPKYYYMDV (SEQ ID NO: 134) |

Alternatively, the anti-FXIIa portion can include one or more (e.g., up to 2, 3, 4, 5, 6, 7, or 8) mutations in one or more of the heavy chain and/or light chain CDRs listed in Table 1 above, as compared to any of the clones 559C-M0071-F06, 559C-M0179-D04, 559C-M0181-C02, 559C-M0180-G03, 559C-M0184-B04, 620I-X0173-A11, 620I-X0173-007, 620I-X0173-E07, or 620I-X0173-G11. Such mutations can be conservative amino acid substitutions as described herein.

In some embodiments, the anti-FXIIa portion in the bispecific antibody described herein is an IgG molecule, which can be a naturally-occurring IgG or a mutant, e.g., comprising one or more (e.g., 1, 2, 3, 4, 5, or more) mutations or deletions, for example to reduce proteolytic cleavage of the bispecific antibody, to reduce charge heterogeneity of the bispecific antibody, and/or to improve expression, production, and/or manufacture of the bispecific antibody. In some embodiments, the heavy chain of the IgG has the C-terminal lysine residue removed or mutated as compared with its wild-type counterpart. In some embodiments, the IgG heavy chain C-terminal lysine is mutated to a neutral amino acid residue, for example, a glycine residue or an alanine residue.

The anti-FXIIa portion in the bispecific antibody can be in any antibody form, including, but not limited to intact (i.e., full-length) antibodies, antigen-binding fragments thereof (such as Fab, Fab', F(ab')$_2$, Fv), and single chain antibodies. In some examples, the heavy chain variable region of the anti-pKal portion as described herein is linked to a heavy chain constant region ($C_H$), which may be the full-length of a heavy chain constant region or a portion thereof (e.g., $C_H1$, $C_H2$, $C_H3$, or a combination thereof). The heavy chain constant region can be derived from any $C_H$ known in the art. In some embodiments, the $C_H$ is a gamma heavy chain. Alternatively or in addition, the light chain variable region of the anti-pKal portion is linked to a light chain constant region ($C_L$), which can be any $C_L$ known in the art. In some examples, the $C_L$ is a kappa light chain. In other examples, the $C_L$ is a lambda light chain. Antibody heavy and light chain constant regions are well known in the art, e.g., described herein.

Alternatively, the anti-FXIIa portion in the bispecific antibody as described herein can be a single-chain antibody, in which a heavy chain variable region and light chain variable region are fused, e.g., via a flexible peptide linker such as the linker of (GGGGS)$_4$ (SEQ ID NO:23). The heavy chain variable region and light chain variable region can be fused in an H→L orientation, or fused in an L→H orientation. In some embodiments, the light chain portion of the ScFv does not contain a KR motif at its C-terminus.

In some embodiments, the anti-FXIIa portion is a scFv comprising a heavy chain variable region of SEQ ID NO:3 or SEQ ID NO:4, and/or a light chain variable region of any of SEQ ID NOs:5-8. In one example, the anti-FXIIa portion is a scFv antibody comprising a heavy chain variable region of SEQ ID NO:3 and a light chain variable region of any of SEQ ID NOs:5-8 in either H→L or L→H orientation. In another example, the anti-FXIIa portion is a scFv antibody comprising a heavy chain variable region of SEQ ID NO:4 and a light chain variable region of SEQ ID NO:5 in either H→L or L→H orientation. In some embodiments, the anti-FXIIa portion is a scFv comprising a heavy chain variable region of any of SEQ ID NOs:123-126, and/or a light chain variable region of any of SEQ ID NOs:127-130. In one example, the anti-FXIIa portion is a scFv antibody comprising a heavy chain variable region of SEQ ID NO:123 and a light chain variable region of SEQ ID NO: 127 in either H→L or L→H orientation. In one example, the anti-FXIIa portion is a scFv antibody comprising a heavy chain variable region of SEQ ID NO:123 and a light chain variable region of SEQ ID NO: 127 in either H→L or L→H orientation. In another example, the anti-FXIIa portion is a scFv antibody comprising a heavy chain variable region of SEQ ID NO:124 and a light chain variable region of SEQ ID NO: 128 in either H→L or L→H orientation. In another example, the anti-FXIIa portion is a scFv antibody comprising a heavy chain variable region of SEQ ID NO:125 and a light chain variable region of SEQ ID NO: 129 in either H→L or L→H orientation. In another example, the anti-FXIIa portion is a scFv antibody comprising a heavy chain variable region of SEQ ID NO:126 and a light chain variable region of SEQ ID NO: 130 in either H→L or L→H orientation.

In some embodiments, the heavy chain and light chain variable region of any of the scFV antibodies described herein are further connected, e.g., via disulfide bond, such as between a $V_H$ residue 44 and a $V_L$ 100 residue.

(iii) Format of the Anti-pKal/Anti-FXII Bispecific Antibodies

The anti-pKal/anti-FXIIa bispecific antibodies as described herein can be in any format of bispecific antibodies as known in the art, e.g., those described in Klein et al., mAbs 4(6):653-663, 2012; Kontermann et al., mAbs 4(2): 182-197, 2012; and Coloma et al., Nature Biotechnology 15:159-163, 1997. In some examples, the bispecific antibody can be a hybrid full-length antibody (also known as a quadroma or trifunctional antibody) comprising one arm (a heavy chain/light chain complex) binding to pKal and another arm (a heavy chain/light chain complex) binding to FXII. In some examples, the bispecific antibody is a bispecific Fab'$_2$, which comprises one Fab fragment binding to pKal and another Fab fragment binding to FXII, or a tri-Fab molecule comprising two copies of a Fab fragment binding to one target antigen (e.g., pKal or FXIIa) and one copy of a Fab fragment binding to the other target antigen (e.g., FXIIa or pKal). Alternatively, the bispecific antibody is a tandem scFv molecule, which comprises at least one copy of a scFv binding to pKal and one copy of another scFv binding to FXIIa. The bispecific antibody described herein can also be a diabody or a single chain diabody as known in the art. Other examples include, but are not limited to, IgG$_2$, F(ab')$_2$, CovX-body, scFv$_4$-Ig, IgG-scFv, scFv-IgG, DVD-Ig, IgG-sVD, sVD-IgG, 2-in-1-IgG, mAb$^2$, Tandemab common LC, kih IgG, kih IgG common LC, CrossMab, kih IgG-scFab, mAb-Fv, charge pairs, SEED-body, Diabody (db), dsDd, scDb, tandAbs, tandem scFv, triple body, Fab-scFv, and F(ab')$_2$-scFv$_2$. See, e.g., FIG. 2 of Kontermann et al., mAbs 4(2):182-197, 2012.

In some embodiments, the scaffold of the bispecific antibodies described herein is designed to comprise an IgG antibody portion and a scFv portion, which is fused to the C-terminus of either a heavy chain or a light chain of the IgG portion (e.g., the C-terminus of the heavy chain of the IgG, see, e.g., Coloma, M. J. & Morrison, S. L. Design and production of novel tetravalent bispecific antibodies. Nature Biotechnology. 15(2): 159-163, 1997). The IgG heavy or light chain can be fused with the scFv via a short peptide linker, such as a peptide that is rich in Gly and Ser residues. In one example, the peptide linker comprises the amino acid sequence of SGGGS (SEQ ID NO:22).

Such a bispecific antibody can comprise a first polypeptide that comprises a light chain of a first antibody, which comprises a light chain variable region ($V_L$) and a light chain constant region ($C_L$); and a second polypeptide that comprises a fusion protein comprising, from the N-terminus to the C-terminus, a heavy chain of the first antibody, which comprises a heavy chain variable region ($V_H$), a heavy chain constant region ($C_H$) and a second antibody, which can be a single chain antibody. Alternatively, the bispecific antibody can comprise a first polypeptide that comprises a heavy chain of a first antibody, the heavy chain comprising a heavy chain variable region ($V_H$) and a heavy chain constant region ($C_H$) or a portion thereof; and a second polypeptide that comprises a fusion protein comprising, from N-terminus to C-terminus, a light chain of the first antibody, which comprises a light chain variable region ($V_L$) and a light chain constant region ($C_L$), and a second antibody, which is a single chain antibody. In some examples, the first antibody can bind to pKal (e.g., active pKal) and the second antibody can bind to FXII (e.g., FXIIa). In other examples, the first antibody can bind to FXIIa and the second antibody can bind to pKal.

The $C_L$ of the light chain of the first antibody may be any $C_L$ known in the art. In some embodiments, the $C_L$ is a kappa light chain. In some embodiments, the $C_L$ is a lambda light chain. The $C_H$ of the heavy chain of the first antibody may be any $C_H$ known in the art. In some embodiments, the $C_H$ is a gamma heavy chain. Such heavy and light chain constant regions are well known in the art, e.g., as described herein.

In one example, the bispecific comprises an IgG antibody derived from DX-2930 and a scFv antibody derived from clone 559C-M0071-F06, 559C-M0179-D04, 559C-M0181-C02, 559C-M0180-G03, 559C-M0184-B04, 620I-X0173-A11, 620I-X0173-007, 620I-X0173-E07, or 620I-X0173-G11, in either H→L or L→H orientation. See above disclosures. An antibody derived from a parent antibody may comprise heavy chain and light chain substantially similar to those of the parent antibody (share at least 80%, 85%, 90%, 95%, or 98% sequence identity). In some examples, such an antibody comprises the same heavy chain and light chain CDRs as the parent antibody. In other examples, such an antibody comprises heavy chain and/or light chain CDRs that are substantially identical to those of the parent antibody, e.g., comprises up to 5, 4, 3, 2, or 1 amino acid residue variations such as conservative amino acid residue substitutions as compared to the CDRs of the parent antibody.

In some embodiments, the scFv antibody in the bispecific antibody comprises a $V_H$ fused to the N-terminus of the $V_L$. In other embodiments, the scFv antibody comprises a $V_H$ fused to the C-terminus of the $V_L$. In any of the scFv antibodies described herein, the $V_H$ and $V_L$ regions can be fused via a linker, such as a peptide linker.

A peptide linker as described herein can comprise, for example, 1, 2, 3, 4, 5, 6, 7, 8, 9, 10 or more amino acid residues. In some embodiments, the peptide linker can comprise 2-50, 5-25, or 5-20 amino acids. In some embodiments, the peptide linker is SGGGS. In some embodiments, the peptide linker is $(G_4S)_x$, wherein x can be 1, 2, 3, 4, 5, 6, 7, 8, 9, 10, or more. In some embodiments, x is 4.

Any of the peptide linkers described herein, e.g., the SGGGS (SEQ ID NO:22) linker or the (GGGGS)$_4$ (SEQ ID NO:23) linker, can comprise naturally occurring amino acids and/or non-naturally occurring amino acids. Naturally occurring amino acids include alanine (Ala), arginine (Arg), asparagine (Asn), aspartic acid (Asp), cysteine (Cys), glutamic acid (Glu), glutamine (Gin), glycine (Gly), histidine (His), isoleucine (He), leucine (Leu), lysine (Lys) methionine (Met), ornithine (Orn), phenylalanine (Phe), proline (Pro), serine (Ser), threonine (Thr), tryptophan (Trp), tyrosine (Tyr), and valine (Val). Non-naturally occurring amino acids can include protected amino acids such as naturally occurring amino acids protected with groups such as acetyl, formyl, tosyl, nitro and the like. Non-limiting examples of non-naturally occurring amino acids include azidohomoalanine, homopropargylglycine, homoallylglycine, p-bromophenylalanine, p-iodophenylalanine, azidophenylalanine, acetylphenylalanine or ethynylephenylalanine, amino acids containing an internal alkene such as trans-crotylalkene, serine allyl ether, allyl glycine, propargyl glycine, vinyl glycine, pyrrolysine, N-sigma-o-azidobenzyloxycarbonyl-L-Lysine (AzZLys), N-sigma-propargyloxycarbonyl-L-Lysine, N-sigma-2-azidoethoxycarbonyl-L-Lysine, N-sigma-tert-butyloxycarbonyl-L-Lysine (BocLys), N-sigma-allyloxycarbonyl-L-Lysine (AlocLys), N-sigma-acetyl-L-

Lysine (AcLys), N-sigma-benzyloxycarbonyl-L-Lysine (ZLys), N-sigma-cyclopentyloxycarbonyl-L-Lysine (CycLys), N-sigma-D-prolyl-L-Lysine, N-sigma-nicotinoyl-L-Lysine (NicLys), N-sigma-N-Me-anthraniloyl-L-Lysine (NmaLys), N-sigma-biotinyl-L-Lysine, N-sigma-9-fluorenylmethoxycarbonyl-L-Lysine, N-sigma-methyl-L-Lysine, N-sigma-dimethyl-L-Lysine, N-sigma-trimethyl-L-Lysine, N-sigma-isopropyl-L-Lysine, N-sigma-dansyl-L-Lysine, N-sigma-o,p-dinitrophenyl-L-Lysine, N-sigma-p-toluenesulfonyl-L-Lysine, N-sigma-DL-2-amino-2carboxyethyl-L-Lysine, N-sigma-phenylpyruvamide-L-Lysine, N-sigma-pyruvamide-L-Lysine, azidohomoalanine, homopropargylglycine, homoallylglycine, p-bromophenylalanine, p-iodophenylalanine, azidophenylalanine, acetylphenylalanine or ethynylephenylalanine, amino acids containing an internal alkene such as trans-crotylalkene, serine allyl ether, allyl glycine, propargyl glycine, and vinyl glycine.

In some embodiments, the scFv portion of the bispecific antibodies described herein may be engineered to introduce cysteine residues in both the $V_H$ and $V_L$ chains for formation of one or more disulfide bonds, which may reduce the formation of high molecular weight aggregates. In some examples, a cysteine residue may be introduced into residue 44 of the $V_H$ chain. Alternatively or in addition, a cysteine residue may be introduced into residue 100 of the $V_L$ chain.

Exemplary anti-pKal/anti-FXIIa bispecific antibodies include clones X0120-A01, X0120-001, X0120-E01, X0120-G01, X0121-A03, X0121-001, X0121-E01, X0121-G01, X0122-A01, X0122-C01, 620I-X0173-A11, 620I-X0173-C07, 620I-X0173-E07, and 620I-X0173-G11 described in Examples below. Other exemplary anti-pKal/anti-FXIIa bispecific antibodies include clones 620I-X138-A08, 620I-X136-B02, 620I-X139-A12, 620I-X137-B08, 620I-X142-A04, 620I-X142-B11, 620I-X138-B01, 620I-X136-C01, 620I-X138-A12, 620I-X136-A12, 620I-X138-A02, 620I-X136-A05, 620I-X138-C07, 620I-X136-E07, 620I-X142-B02, 620I-X136-F11, 620I-X142-A05, 620I-X136-C09, 620I-X138-B10, 620I-X136-008, 620I-X139-A11, 620I-X136-D05, 620I-X138-D04, 620I-X136-G08, 620I-X142-B07, 620I-X142-A11, 620I-X138-G12, 620I-X142-A10, 620I-X138-D03, 620I-X137-C08, 620I-X142-E02, 620I-X136-E05, 620I-X138-B06, 620I-X136-A09, 620I-X138-A06, 620I-X137-A10, 620I-X139-B10, 620I-X136-A04, 620I-X138-D06, 620I-X136-C11, 620I-X138-B07, so 620I-X136-A02, 620I-X139-G02, 620I-X136-B07, 620I-X138-E03, 620I-X136-G05, 620I-X139-D12, 620I-X136-A01, 620I-X138-C12, 620I-X136-G10, 620I-X138-D05, 620I-X136-F07, 620I-X138-A01, 620I-X142-E09, 620I-X138-D11, 620I-X136-C05, 620I-X142-A02, 620I-X136-C04, 620I-X138-F02, 620I-X136-G04, 620I-X139-G12, 620I-X136-B11, 620I-X142-D04, 620I-X136-D06, 620I-X139-A01, 620I-X136-D12, 620I-X138-F05, 620I-X136-A11, 620I-X139-E05, 620I-X136-C12, and 620I-X138-E05 described in the Examples below.

Preparation of Bispecific Antibodies

Any suitable methods known in the art, e.g., the standard recombinant technology, can be used for preparing the bispecific antibodies described herein. Examples are provided below.

Heavy chain and light chain genes of suitable parent antibodies can be obtained via routine technology, e.g., PCR amplification from a suitable source. In one example, DNA encoding a monoclonal antibody specific to a target antigen can be readily isolated and sequenced using conventional procedures (e.g., by using oligonucleotide probes that are capable of binding specifically to genes encoding the heavy and light chains of the monoclonal antibodies). A cell, such as a hybridoma cell, may serve as a source of such DNA. In another example, the sequence of DNA encoding a monoclonal antibody specific for a target antigen may be obtained, e.g., from a database or other publically available source, and the DNA can be synthesized. The parent antibody genes can also be obtained from screening a suitable antibody library with an antigen of interest.

The antibody heavy and light chain genes thus obtained can be analyzed to identify the complementarity determining regions (CDR) regions following routine technology. Any of the polypeptides in the bispecific antibodies as described herein can be prepared via conventional recombinant technology and inserted into suitable expression vectors for production in suitable host cells.

The nucleotide sequences encoding one or more of the polypeptides of a bispecific antibody as described herein can be cloned into one expression vector, each nucleotide sequence being in operable linkage to a suitable promoter. Alternatively, the nucleotides sequences can be in operable linkage with a single promoter, such that both sequences are expressed from the same promoter. In some examples, the expression of the two polypeptides is controlled by a common promoter. In other examples, the expression of each of the two polypeptides is under the control of a distinct promoter. In another alternative, the nucleotide sequences encoding the two polypeptides are cloned into two vectors, which can be introduced into the same or different cells. When the two polypeptides are expressed in different cells, each of them can be isolated from the host cells expressing such and the two isolated heavy chains can be mixed and incubated under suitable conditions allowing for the formation of the bispecific antibody.

Generally, a nucleic acid sequence encoding one or all chains of a bispecific antibody can be cloned into a suitable expression vector in operable linkage with a suitable promoter using methods known in the art. For example, the nucleotide sequence and vector can be contacted, under suitable conditions, with a restriction enzyme to create complementary ends on each molecule that can pair with each other and be joined together with a ligase. Alternatively, synthetic nucleic acid linkers can be ligated to the termini of a gene. These synthetic linkers contain nucleic acid sequences that correspond to a particular restriction site in the vector. The selection of expression vectors/promoter would depend on the type of host cells for use in producing the antibodies.

A variety of promoters can be used for expression of the bispecific antibodies described herein, including, but not limited to, cytomegalovirus (CMV) intermediate early promoter, a viral LTR such as the Rous sarcoma virus LTR, HIV-LTR, HTLV-1 LTR, the simian virus 40 (SV40) early promoter, E. coli lac UV5 promoter, and the herpes simplex tk virus promoter.

Regulatable promoters can also be used. Such regulatable promoters include those using the lac repressor from E. coli as a transcription modulator to regulate transcription from lac operator-bearing mammalian cell promoters [Brown, M. et al., Cell, 49:603-612 (1987)], those using the tetracycline repressor (tetR) [Gossen, M., and Bujard, H., Proc. Natl. Acad. Sci. USA 89:5547-5551 (1992); Yao, F. et al., Human Gene Therapy, 9:1939-1950 (1998); Shockelt, P., et al., Proc. Natl. Acad. Sci. USA, 92:6522-6526 (1995)]. Other systems include FK506 dimer, VP16 or p65 using astradiol, RU486, diphenol murislerone, or rapamycin. Inducible systems are available from Invitrogen, Clontech and Ariad.

Regulatable promoters that include a repressor with the operon can be used. In one embodiment, the lac repressor from *E. coli* can function as a transcriptional modulator to regulate transcription from lac operator-bearing mammalian cell promoters [M. Brown et al., *Cell*, 49:603-612 (1987)]; Gossen and Bujard (1992); [M. Gossen et al., *Natl. Acad. Sci. USA*, 89:5547-5551 (1992)] combined the tetracycline repressor (tetR) with the transcription activator (VP 16) to create a tetR-mammalian cell transcription activator fusion protein, tTa (tetR-VP 16), with the tetO-bearing minimal promoter derived from the human cytomegalovirus (hCMV) major immediate-early promoter to create a tetR-tet operator system to control gene expression in mammalian cells. In one embodiment, a tetracycline inducible switch is used. The tetracycline repressor (tetR) alone, rather than the tetR-mammalian cell transcription factor fusion derivatives can function as potent trans-modulator to regulate gene expression in mammalian cells when the tetracycline operator is properly positioned downstream for the TATA element of the CMVIE promoter (Yao et al., *Human Gene Therapy*). One particular advantage of this tetracycline inducible switch is that it does not require the use of a tetracycline repressor-mammalian cells transactivator or repressor fusion protein, which in some instances can be toxic to cells (Gossen et al., Natl. Acad. Sci. USA, 89:5547-5551 (1992); Shockett et al., *Proc. Natl. Acad. Sci. USA*, 92:6522-6526 (1995)), to achieve its regulatable effects.

Additionally, the vector can contain, for example, some or all of the following: a selectable marker gene, such as the neomycin gene for selection of stable or transient transfectants in mammalian cells; enhancer/promoter sequences from the immediate early gene of human CMV for high levels of transcription; transcription termination and RNA processing signals from SV40 for mRNA stability; SV40 polyoma origins of replication and ColE1 for proper episomal replication; internal ribosome binding sites (IRESes), versatile multiple cloning sites; and T7 and SP6 RNA promoters for in vitro transcription of sense and antisense RNA. Suitable vectors and methods for producing vectors containing transgenes are well known and available in the art.

Examples of polyadenylation signals useful to practice the methods described herein include, but are not limited to, human collagen I polyadenylation signal, human collagen II polyadenylation signal, and SV40 polyadenylation signal.

Other aspects of the disclosure relate to a method for preparing a bispecific antibody, comprising: culturing a host cell or host cell set described herein under conditions allowing for expression of the first polypeptide and the second polypeptide; and isolating the bispecific antibody that comprises the first polypeptide and the second polypeptide. In some embodiments, the host cell comprises an expression vector comprising a first nucleotide sequence encoding a first polypeptide as described herein and a second nucleotide sequence encoding a second polypeptide as described herein.

Suitable host cells for use in preparing the bispecific antibodies described herein can be any host cells known in the art that can be used for protein production, including, but not limited to, bacterial cells, yeast cells, insect cells, plant cells, or mammalian cells. The bispecific antibodies described herein can be produced in bacterial cells, e.g., *E. coli* cells. Alternatively, the bispecific antibodies can be produced in eukaryotic cells. In one embodiment, the antibodies are expressed in a yeast cell such as *Pichia* (see, e.g., Powers et al., 2001, *J. Immunol. Methods*. 251:123-35), *Hansenula*, or *Saccharomyces*. In another embodiment, the bispecific antibodies can be produced in mammalian cells. Mammalian host cells for expressing the antibodies include, but are not limited to, 293 cells (see, e.g., ATCC CRL-1573, American Type Culture Collection®, and Expi293F'M cells, Life Technologies™), Chinese Hamster Ovary (CHO cells) (including dhfr– CHO cells, described in Urlaub and Chasin, 1980, *Proc. Natl. Acad. Sci. USA* 77:4216-4220, used with a DHFR selectable marker, e.g., as described in Kaufman and Sharp, 1982, *Mol. Biol.* 159:601 621), lymphocytic cell lines, e.g., NSO myeloma cells and SP2 cells, COS cells, and a cell from a transgenic animal, e.g., a transgenic mammal. For example, the cell is a mammary epithelial cell.

In an exemplary system for recombinant expression of a bispecific antibody as described herein, a recombinant expression vector encoding both of the polypeptides in the bispecific antibody is introduced into dhfr– CHO cells by calcium phosphate-mediated transfection. Within the recombinant expression vector, the nucleic acids encoding the two polypeptides are operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the two polypeptides. The tetrameric molecule formed thereby can be recovered from the culture medium. Another exemplary system for recombinant expression is described in Example 2.

Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

Utilities of the Bispecific Antibodies

The bispecific antibodies or the encoding nucleic acids or nucleic acid sets described herein can be used for diagnostic and therapeutic purposes. They also can be used as research tools in basic researches and therapeutic researches.

(i) Pharmaceutical Compositions

The hi specific antibody (or the encoding nucleic acids or nucleic acid sets) as described herein can be mixed with a pharmaceutically acceptable carrier (excipient), including buffer, to form a pharmaceutical composition for use in treating a target disease. "Acceptable" means that the carrier must be compatible with the active ingredient of the composition (and preferably, capable of stabilizing the active ingredient) and not deleterious to the subject to be treated. Pharmaceutically acceptable excipients (carriers) including buffers, which are well known in the art. See, e.g., Remington: The Science and Practice of Pharmacy 20th Ed. (2000) Lippincott Williams and Wilkins, Ed. K. E. Hoover.

The pharmaceutical compositions to be used in the present methods can comprise pharmaceutically acceptable carriers, excipients, or stabilizers in the form of lyophilized formulations or aqueous solutions. (Remington: The Science and Practice of Pharmacy 20th Ed. (2000) Lippincott Williams and Wilkins, Ed. K. E. Hoover). Acceptable carriers, excipients, or stabilizers are nontoxic to recipients at the dosages and concentrations used, and may comprise buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

In some examples, the pharmaceutical composition described herein comprises liposomes containing the bispecific antibody, which can be prepared by methods known in the art, such as described in Epstein, et al., Proc. Natl. Acad. Sci. USA 82:3688 (1985); Hwang, et al., Proc. Natl. Acad. Sci. USA 77:4030 (1980); and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter.

The bispecific antibody, or the encoding nucleic acid(s), may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are known in the art, see, e.g., Remington, The Science and Practice of Pharmacy 20th Ed. Mack Publishing (2000).

In other examples, the pharmaceutical composition described herein can be formulated in sustained-release format. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(v nylalcohol)), polylactides (U.S. Pat. No. 3,773,919), copolymers of L-glutamic acid and 7 ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), sucrose acetate isobutyrate, and poly-D-(-)-3-hydroxybutyric acid.

The pharmaceutical compositions to be used for in vivo administration must be sterile. This is readily accomplished by, for example, filtration through sterile filtration membranes. Therapeutic antibody compositions are generally placed into a container having a sterile access port, for example, an intravenous solution bag or vial having a stopper pierceable by a hypodermic injection needle.

The pharmaceutical compositions described herein can be in unit dosage forms such as tablets, pills, capsules, powders, granules, solutions or suspensions, or suppositories, for oral, parenteral or rectal administration, or administration by inhalation or insufflation. For preparing solid compositions such as tablets, the principal active ingredient can be mixed with a pharmaceutical carrier, e.g. conventional tableting ingredients such as corn starch, lactose, sucrose, sorbitol, talc, stearic acid, magnesium stearate, dicalcium phosphate or gums, and other pharmaceutical diluents, e.g. water, to form a solid preformulation composition containing a homogeneous mixture of a compound of the present invention, or a non-toxic pharmaceutically acceptable salt thereof. When referring to these preformulation compositions as homogeneous, it is meant that the active ingredient is dispersed evenly throughout the composition so that the composition may be readily subdivided into equally effective unit dosage forms such as tablets, pills and capsules. This solid preformulation composition is then subdivided into unit dosage forms of the type described above containing from 0.1 to about 500 mg of the active ingredient of the present invention. The tablets or pills of the novel composition can be coated or otherwise compounded to provide a dosage form affording the advantage of prolonged action. For example, the tablet or pill can comprise an inner dosage and an outer dosage component, the latter being in the form of an envelope over the former. The two components can be separated by an enteric layer that serves to resist disintegration in the stomach and permits the inner component to pass intact into the duodenum or to be delayed in release. A variety of materials can be used for such enteric layers or coatings, such materials including a number of polymeric acids and mixtures of polymeric acids with such materials as shellac, cetyl alcohol and cellulose acetate.

Suitable surface-active agents include, in particular, non-ionic agents, such as polyoxyethylenesorbitans (e.g. Tween™ 20, 40, 60, 80 or 85) and other sorbitans (e.g. Span™ 20, 40, 60, 80 or 85). Compositions with a surface-active agent will conveniently comprise between 0.05 and 5% surface-active agent, and can be between 0.1 and 2.5%. It will be appreciated that other ingredients may be added, for example mannitol or other pharmaceutically acceptable vehicles, if necessary.

Suitable emulsions may be prepared using commercially available fat emulsions, such as Intralipid™, Liposyn™, Infonutrol™, Lipofundin™ and Lipiphysan™. The active ingredient may be either dissolved in a pre-mixed emulsion composition or alternatively it may be dissolved in an oil (e.g. soybean oil, safflower oil, cottonseed oil, sesame oil, corn oil or almond oil) and an emulsion formed upon mixing with a phospholipid (e.g. egg phospholipids, soybean phospholipids or soybean lecithin) and water. It will be appreciated that other ingredients may be added, for example glycerol or glucose, to adjust the tonicity of the emulsion. Suitable emulsions will typically contain up to 20% oil, for example, between 5 and 20%. The fat emulsion can comprise fat droplets between 0.1 and 1.0 .im, particularly 0.1 and 0.5 .im, and have a pH in the range of 5.5 to 8.0.

The emulsion compositions can be those prepared by mixing a bispecific antibody with Intralipid™ or the components thereof (soybean oil, egg phospholipids, glycerol and water).

Pharmaceutical compositions for inhalation or insufflation include solutions and suspensions in pharmaceutically acceptable, aqueous or organic solvents, or mixtures thereof, and powders. The liquid or solid compositions may contain suitable pharmaceutically acceptable excipients as set out above. In some embodiments, the compositions are administered by the oral or nasal respiratory route for local or systemic effect.

Compositions in preferably sterile pharmaceutically acceptable solvents may be nebulised by use of gases.

Nebulised solutions may be breathed directly from the nebulising device or the nebulising device may be attached to a face mask, tent or intermittent positive pressure breathing machine. Solution, suspension or powder compositions may be administered, preferably orally or nasally, from devices which deliver the formulation in an appropriate manner.

(ii) Disease Treatment

The bispecific antibodies (or the encoding nucleic acids or nucleic acid sets) described herein are useful for treating a disease or disorder associated one or both of the antigens to which the bispecific antibody binds. For example, if the bispecific antibody is capable of binding to and blocking the activity of pKal and FXIIa, it can be used for treating diseases associated with dysregulation of the contact activation system, e.g., HAE and thrombosis.

HAE (including Type I. Type II, and Type III HAE) is a disorder characterized by recurrent episodes of severe swelling at, e.g., the limbs, face, intestinal tract, and airway. HAE attach may be triggered by minor trauma or stress. Swelling the intestinal tract due to HAE attack can cause severe abdominal pain, nausea, and vomiting. Swelling in the airway can restrict breathing and lead to life-threatening obstruction of the airway.

Thrombosis (e.g., venous thrombosis or arterial thrombosis) refers to the formation of blood clots inside a blood vessel, which may obstruct the flow of blood through the circulation system. Thrombosis may include thrombosis associated with atrial fibrillation. DVT, pulmonary embolism, stroke, or other arterial or venous thrombotic events To practice the method disclosed herein, an effective amount of the pharmaceutical composition described above can be administered to a subject (e.g., a human) in need of the treatment via a suitable route, such as intravenous administration, e.g., as a bolus or by continuous infusion over a period of time, by intramuscular, intraperitoneal, intracerebrospinal, subcutaneous, intra-articular, intrasynovial, intrathecal, oral, inhalation or topical routes. Commercially available nebulizers for liquid formulations, including jet nebulizers and ultrasonic nebulizers are useful for administration. Liquid formulations can be directly nebulized and lyophilized powder can be nebulized after reconstitution. Alternatively, the bispecific antibodies as described herein can be aerosolized using a fluorocarbon formulation and a metered dose inhaler, or inhaled as a lyophilized and milled powder.

The subject to be treated by the methods described herein can be a mammal, more preferably a human. Mammals include, but are not limited to, farm animals, sport animals, pets, primates, horses, dogs, cats, mice and rats. A human subject who needs the treatment may be a human patient having, at risk for, or suspected of having a target disease/disorder, such as HAE or thrombosis. In some embodiments, thrombosis is associated with atrial fibrillation, deep vein thrombosis (DVT), pulmonary embolism, stroke, or an arterial or venous thrombotic event. A subject having a target disease or disorder can be identified by routine medical examination, e.g., laboratory tests, organ functional tests, CT scans, or ultrasounds. A subject suspected of having any of such target disease/disorder might show one or more symptoms of the disease/disorder. A subject at risk for the disease/disorder can be a subject having one or more of the risk factors for that disease/disorder.

"An effective amount" as used herein refers to the amount of each active agent required to confer therapeutic effect on the subject, either alone or in combination with one or more other active agents. Effective amounts vary, as recognized by those skilled in the art, depending on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a patient may insist upon a lower dose or tolerable dose for medical reasons, psychological reasons or for virtually any other reasons.

Empirical considerations, such as the half-life, generally will contribute to the determination of the dosage. For example, antibodies that are compatible with the human immune system, such as humanized antibodies or fully human antibodies, may be used to prolong half-life of the antibody and to prevent the antibody being attacked by the host's immune system. Frequency of administration may be determined and adjusted over the course of therapy, and is generally, but not necessarily, based on treatment and/or suppression and/or amelioration and/or delay of a target disease/disorder. Alternatively, sustained continuous release formulations of a bispecific antibody may be appropriate. Various formulations and devices for achieving sustained release are known in the art.

In one example, dosages for a bispecific antibody as described herein may be determined empirically in individuals who have been given one or more administration(s) of the antibody. Individuals are given incremental dosages of the antagonist. To assess efficacy of the antagonist, an indicator of the disease/disorder can be followed.

Generally, for administration of any of the antibodies described herein, an initial candidate dosage can be about 2 mg/kg. For the purpose of the present disclosure, a typical daily dosage might range from about any of 0.1 µg/kg to 3 µg/kg to 30 µg/kg to 300 µg/kg to 3 mg/kg, to 30 mg/kg to 100 mg/kg or more, depending on the factors mentioned above. For repeated administrations over several days or longer, depending on the condition, the treatment is sustained until a desired suppression of symptoms occurs or until sufficient therapeutic levels are achieved to alleviate a target disease or disorder, or a symptom thereof. An exemplary dosing regimen comprises administering an initial dose of about 2 mg/kg, followed by a weekly maintenance dose of about 1 mg/kg of the antibody, or followed by a maintenance dose of about 1 mg/kg every other week. However, other dosage regimens may be useful, depending on the pattern of pharmacokinetic decay that the practitioner wishes to achieve. For example, dosing from one-four times a week is contemplated. In some embodiments, dosing ranging from about 3 µg/mg to about 2 mg/kg (such as about 3 µg/mg, about 10 µg/mg, about 30 µg/mg, about 100 µg/mg, about 300 µg/mg, about 1 mg/kg, and about 2 mg/kg) may be used. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays. The dosing regimen (including the antibody used) can vary over time.

In some embodiments, for an adult patient of normal weight, doses ranging from about 0.3 to 5.00 mg/kg may be administered. The particular dosage regimen, i.e., dose, timing and repetition, will depend on the particular individual and that individual's medical history, as well as the properties of the individual agents (such as the half-life of the agent, and other considerations well known in the art).

For the purpose of the present disclosure, the appropriate dosage of a bispecific antibody as described herein will depend on the specific antibody (or compositions thereof) employed, the type and severity of the disease/disorder, whether the antibody is administered for preventive or therapeutic purposes, previous therapy, the patient's clinical history and response to the antagonist, and the discretion of the attending physician. Typically the clinician will administer a bispecific antibody, until a dosage is reached that achieves the desired result. Administration of one or more bispecific antibody can be continuous or intermittent, depending, for example, upon the recipient's physiological condition, whether the purpose of the administration is therapeutic or prophylactic, and other factors known to skilled practitioners. The administration of a bispecific antibody may be essentially continuous over a preselected period of time or may be in a series of spaced dose, e.g., either before, during, or after developing a target disease or disorder.

As used herein, the term "treating" refers to the application or administration of a composition including one or more active agents to a subject, who has a target disease or disorder, a symptom of the disease/disorder, or a predisposition toward the disease/disorder, with the purpose to cure, heal, alleviate, relieve, alter, remedy, ameliorate, improve, or affect the disorder, the symptom of the disease, or the predisposition toward the disease or disorder.

Alleviating a target disease/disorder includes delaying the development or progression of the disease, or reducing disease severity. Alleviating the disease does not necessarily require curative results. As used therein, "delaying" the development of a target disease or disorder means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset. As used herein "onset" or "occurrence" of a target disease or disorder includes initial onset and/or recurrence.

In some embodiments, the bispecific antibody described herein is administered to a subject in need of the treatment at an amount sufficient to inhibit the activity of one or both of the target antigen by at least 20% (e.g., 30%, 40%, 50%, 60%, 70%, 80%, 90% or greater) in vivo. In other embodiments, the antibody is administered in an amount effective in reducing the level of one or both target antigens by at least 20% (e.g., 30%, 40%, 50%, 60%, 70%, 80%, 90% or greater).

Conventional methods, known to those of ordinary skill in the art of medicine, can be used to administer the pharmaceutical composition to the subject, depending upon the type of disease to be treated or the site of the disease. This composition can also be administered via other conventional routes, e.g., administered orally, parenterally, by inhalation spray, topically, rectally, nasally, buccally, vaginally or via an implanted reservoir. The term "parenteral" as used herein includes subcutaneous, intracutaneous, intravenous, intramuscular, intraarticular, intraarterial, intrasynovial, intrasternal, intrathecal, intralesional, and intracranial injection or infusion techniques. In addition, it can be administered to the subject via injectable depot routes of administration such as using 1-, 3-, or 6-month depot injectable or biodegradable materials and methods.

Injectable compositions may contain various carriers such as vegetable oils, dimethylactamide, dimethyformamide, ethyl lactate, ethyl carbonate, isopropyl myristate, ethanol, and polyols (glycerol, propylene glycol, liquid polyethylene glycol, and the like). For intravenous injection, water soluble antibodies can be administered by the drip method, whereby a pharmaceutical formulation containing the antibody and a physiologically acceptable excipients is infused. Physiologically acceptable excipients may include, for example, 5% dextrose, 0.9% saline, Ringer's solution or other suitable excipients. Intramuscular preparations, e.g., a sterile formulation of a suitable soluble salt form of the antibody, can be dissolved and administered in a pharmaceutical excipient such as Water-for-Injection, 0.9% saline, or 5% glucose solution.

In one embodiment, a bispecific antibody is administered via site-specific or targeted local delivery techniques. Examples of site-specific or targeted local delivery techniques include various implantable depot sources of the bispecific antibody or local delivery catheters, such as infusion catheters, an indwelling catheter, or a needle catheter, synthetic grafts, adventitial wraps, shunts and stents or other implantable devices, site specific carriers, direct injection, or direct application. See, e.g., PCT Publication No. WO 00/53211 and U.S. Pat. No. 5,981,568.

Targeted delivery of therapeutic compositions containing an antisense polynucleotide, expression vector, or subgenomic polynucleotides can also be used. Receptor-mediated DNA delivery techniques are described in, for example, Findeis et al., Trends Biotechnol. (1993) 11:202; Chiou et al., Gene Therapeutics: Methods And Applications Of Direct Gene Transfer (J. A. Wolff, ed.) (1994); Wu et al., J. Biol. Chem. (1988) 263:621; Wu et al., J. Biol. Chem. (1994) 269:542; Zenke et al., Proc. Natl. Acad. Sci. USA (1990) 87:3655; Wu et al., J. Biol. Chem. (1991) 266:338.

Therapeutic compositions containing a polynucleotide (e.g., those encoding the bispecific antibodies described herein) are administered in a range of about 100 ng to about 200 mg of DNA for local administration in a gene therapy protocol. In some embodiments, concentration ranges of about 500 ng to about 50 mg, about 1 μg to about 2 mg, about 5 μg to about 500 and about 20 μg to about 100 μg of DNA or more can also be used during a gene therapy protocol.

The therapeutic polynucleotides and polypeptides described herein can be delivered using gene delivery vehicles. The gene delivery vehicle can be of viral or non-viral origin (see generally, Jolly, Cancer Gene Therapy (1994) 1:51; Kimura, Human Gene Therapy (1994) 5:845;

Connelly, Human Gene Therapy (1995) 1:185; and Kaplitt, Nature Genetics (1994) 6:148). Expression of such coding sequences can be induced using endogenous mammalian or heterologous promoters and/or enhancers. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., PCT Publication Nos. WO 90/07936; WO 94/03622; WO 93/25698; WO 93/25234; WO 93/11230; WO 93/10218; WO 91/02805; U.S. Pat. Nos. 5,219,740 and 4,777,127; GB Patent No. 2,200,651; and EP Patent No. 0 345 242), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., PCT Publication Nos. WO 94/12649, WO 93/03769; WO 93/19191; WO 94/28938; WO 95/11984 and WO 95/00655). Administration of DNA linked to killed adenovirus as described in Curiel, Hum. Gene Ther. (1992) 3:147 can also be employed.

Non-viral delivery vehicles and methods can also be employed, including, but not limited to, polycationic condensed DNA linked or unlinked to killed adenovirus alone (see, e.g., Curiel, Hum. Gene Ther. (1992) 3:147); ligand-linked DNA (see, e.g., Wu, J. Biol. Chem. (1989) 264: 16985); eukaryotic cell delivery vehicles cells (see, e.g., U.S. Pat. No. 5,814,482; PCT Publication Nos. WO 95/07994; WO 96/17072; WO 95/30763; and WO 97/42338) and nucleic charge neutralization or fusion with cell membranes. Naked DNA can also be employed. Exemplary naked DNA introduction methods are described in PCT Publication No. WO 90/11092 and U.S. Pat. No. 5,580,859. Liposomes that can act as gene delivery vehicles are described in U.S. Pat. No. 5,422,120; PCT Publication Nos. WO 95/13796; WO 94/23697; WO 91/14445; and EP Patent No. 0524968. Additional approaches are described in Philip, Mol. Cell. Biol. (1994) 14:2411, and in Woffendin, Proc. Natl. Acad. Sci. (1994) 91:1581.

The particular dosage regimen, i.e., dose, timing and repetition, used in the method described herein will depend on the particular subject and that subject's medical history. In some embodiments, more than one bispecific antibodies, or a combination of a bispecific antibody and another suitable therapeutic agent, may be administered to a subject in need of the treatment. The bispecific antibody can also be used in conjunction with other agents that serve to enhance and/or complement the effectiveness of the agents.

Treatment efficacy for a target disease/disorder can be assessed by methods well-known in the art.

Kits for Use in Treating Target Diseases

The present disclosure also provides kits for use in alleviating target diseases or disorders. Such kits can include one or more containers comprising one or more of the bispecific antibodies and/or one or more the isolated nucleic acids or nucleic acid sets described herein.

In some embodiments, the kit can comprise instructions for use in accordance with any of the methods described herein. The included instructions can comprise a description of administration of the bispecific antibody to treat, delay the onset, or alleviate a target disease such as HAE or thrombosis. The kit may further comprise a description of selecting an individual suitable for treatment based on identifying whether that individual has the target disease. In still other embodiments, the instructions comprise a description of administering an antibody to an individual at risk of the target disease.

The instructions relating to the use of a bispecific antibody as described herein generally include information as to dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The label or package insert indicates that the composition is used for treating, delaying the onset and/or alleviating a target disease or disorder. Instructions may be provided for practicing any of the methods described herein.

The kits of this invention are in suitable packaging. Suitable packaging includes, but is not limited to, vials, bottles, jars, flexible packaging (e.g., sealed Mylar or plastic bags), and the like. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is a bispecific antibody as those described herein.

Kits may optionally provide additional components such as buffers and interpretive information. Normally, the kit comprises a container and a label or package insert(s) on or associated with the container. In some embodiments, the invention provides articles of manufacture comprising contents of the kits described above.

General Techniques

The practice of the present invention will employ, unless otherwise indicated, conventional techniques of molecular biology (including recombinant techniques), microbiology, cell biology, biochemistry and immunology, which are within the skill of the art. Such techniques are explained fully in the literature, such as, Molecular Cloning: A Laboratory Manual, second edition (Sambrook, et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-8) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel, et al., eds., 1987); PCR: The Polymerase Chain Reaction, (Mullis, et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995).

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

Example 1: Construction and Characterization of Exemplary Bispecific Antibodies that Bind pKal and Factor XIIa A number of exemplary anti-pKal/anti-FXIIa bispecific antibodies, including clones X0120-A01, X0120-001, X0120-E01, X0120-G01, X0121-A03, X0121-001, X0121-E01, X0121-G01, X0122-A01, and X0122-001, were constructed, using DX-2930 and one of anti-FXIIa clones 559C-M0071-F06, 559C-M0184-B04, 559C-M0179-D04, 559C-M0181-C02 and 559C-M0180-G03 as the parent antibodies. See Table 2 below:

TABLE 2

Components of Exemplary Bispecific Antibodies

| Bispecific Antibody Clones | Anti-pKal portion | Anti-FXIIa portion |
|---|---|---|
| X0120-A01 | DX-2930 (IgG) | scFv of clone 559C-M0184-B04 (H→L) fused to the C-terminus of the heavy chain of DX-2930 |
| X0120-C01 | DX-2930 (IgG) | scFv of clone 559C-M0184-B04 (L→H) fused to the C-terminus of the heavy chain of DX-2930 |
| X0120-E01 | DX-2930 (IgG) | scFv of clone 559C-M0179-D04 (H→L) fused to the C-terminus of the heavy chain of DX-2930 |
| X0120-G01, | DX-2930 (IgG) | scFv of clone 559C-M0179-D04 (L→H) fused to the C-terminus of the heavy chain of DX-2930 |
| X0121-A03 | DX-2930 (IgG) | scFv of clone 559C-M0181-C02 (H→L) fused to the C-terminus of the heavy chain of DX-2930 |
| X0121-C01 | DX-2930 (IgG) | scFv of clone 559C-M0181-C02 (L→H) fused to the C-terminus of the heavy chain of DX-2930 |
| X0121-E01 | DX-2930 (IgG) | scFv of clone 559C-M0180-G03 (H→L) fused to the C-terminus of the heavy chain of DX-2930 |
| X0121-G01 | DX-2930 (IgG) | scFv of clone 559C-M0180-G03 (L→H) fused to the C-terminus of the heavy chain of DX-2930 |
| X0122-A01, | DX-2930 (IgG) | scFv of clone 559C-M0071-F06 (H→L) fused to the C-terminus of the heavy chain of DX-2930 |
| X0122-C01 | DX-2930 (IgG) | scFv of clone 559C-M0071-F06 (L→H) fused to the C-terminus of the heavy chain of DX-2930 |

Among the anti-FXIIa clones, 559C-M0071-F06 is a parental clone, 559C-M0184-so B04 is obtained from HCDR1+2 Affinity maturation, and 559C-M0179-D04, 559C-M0181-C02, and 559C-M0180-G03 are clones obtained from light chain affinity maturation.

All of the exemplary bispecific antibodies clones listed in Table 2 above are tetravalent molecules comprising four polypeptide chains, including two polypeptide chains of the light chain of DX-2930 (SEQ ID NO: 10 provided above), and two fusion polypeptide chains of the heavy chain of DX-2930 (excluding a Lysine residue in the hinge domain of the constant chain) fused to a scFv chain of one of the FXIIa clones. The scFv chain of each of the 5 anti-FXIIa clones was synthesized in both the Heavy-Light (H→L) orientation and Light-Heavy orientation (L→H). In all examples of the scFv chains, an internal $(GGGGS)_4$ linker (SEQ ID NO:23) was used. The scFvs were constructed such that clones in the Light-Heavy orientation contained the initial two amino acids (RT) that initiate the constant region before the linker sequence begins. The clones in the Heavy-Light orientation contained only the first amino acid (R) from the light constant region before the stop codons.

The amino acid sequences of the fusion polypeptides of each of the exemplary bispecific antibodies are provided below:

```
Bispecific antibody clone X0120-A01 Heavy
Chain-ScFv Fusion (SEQ ID NO: 11):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSEVQLLESGGGLVQPGGSLRLSCAAS

GFTFSFYSMHWVRQAPGKGLEWVSRIYPSGGVTKYADSVKGRFTISRDNS

KNTLYLQMNSLRAEDTAVYYCTRQRYRGPKYYYYMDVWGKGTTVTVSSGG

GGSGGGGSGGGGSGGGGSDIQMTQSPLSLPVTPGEPASISCRSSQSLLHS

NGYNYLDWYLQKPGQSPQLLIYLGSNRASGVPDRFSGSGSGTDFTLKISR

VEAEDVGVYYCMQALQTPWTFGQGTKVEIKR

Bispecific antibody clone X0120-C01 Heavy
Chain-ScFv Fusion (SEQ ID NO: 12):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSDIQMTQSPLSLPVTPGEPASISCRS

SQSLLHSNGYNYLDWYLQKPGQSPQLLIYLGSNRASGVPDRFSGSGSGTD

FTLKISRVEAEDVGVYYCMQALQTPWTFGQGTKVEIKRTGGGGSGGGGSG

GGGSGGGGSEVQLLESGGGLVQPGGSLRLSCAASGFTFSFYSMHWVRQAP
```

GKGLEWVSRIYPSGGVTKYADSVKGRFTISRDNSKNTLYLQMNSLRAEDT

AVYYCTRQRYRGPKYYYYMDVWGKGTTVTVSS

Bispecific antibody clone X0120-E01 Heavy
Chain-ScFv Fusion (SEQ ID NO: 13):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSEVQLLESGGGLVQPGGSLRLSCAAS

GFTFSGYIMAWVRQAPGKGLEWVSYIYPSGGITVYADSVKGRFTISRDNS

KNTLYLQMNSLRAEDTAVYYCTRQRYRGPKYYYYMDVWGKGTTVTVSSGG

GGSGGGGSGGGGSGGGGSDIQMTQSPLSLSVAPGEPASISCRSSQSLLHR

NGHNYLDWYLQKPGQSPQLLIYLGSNRASGVPERFSGSGSGTDFTLRISR

VEAEDVGVYYCMQALQARTFGQGTKVEIKR

Bispecific antibody clone X0120-G01 Heavy
Chain-ScFv Fusion (SEQ ID NO: 14):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSDIQMTQSPLSLSVAPGEPASISCRS

SQSLLHRNGHNYLDWYLQKPGQSPQLLIYLGSNRASGVPERFSGSGSGTD

FTLRISRVEAEDVGVYYCMQALQARTFGQGTKVEIKRTGGGGSGGGGSGG

GGSGGGGSEVQLLESGGGLVQPGGSLRLSCAASGFTFSGYIMAWVRQAPG

KGLEWVSYIYPSGGITVYADSVKGRFTISRDNSKNTLYLQMNSLRAEDTA

VYYCTRQRYRGPKYYYYMDVWGKGTTVTVSS

Bispecific antibody clone X0121-A03 Heavy
Chain-ScFv Fusion (SEQ ID NO: 15):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSEVQLLESGGGLVQPGGSLRLSCAAS

GFTFSGYIMAWVRQAPGKGLEWVSYIYPSGGITVYADSVKGRFTISRDNS

KNTLYLQMNSLRAEDTAVYYCTRQRYRGPKYYYYMDVWGKGTTVTVSSGG

GGSGGGGSGGGGSGGGGSDIQMTQSPLSLPVTPGEPASISCRSSQSLLHS

NGYNYLDWYLQKPGQSPQLLIYLGSNRASGVPDRFSGSGSGTDFTLKISR

VEAEDVGVYYCMQALQTRTFGQGTKVEIKR

Bispecific antibody clone X0121-C01 Heavy
Chain-ScFv Fusion (SEQ ID NO: 16):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSDIQMTQSPLSLPVTPGEPASISCRS

SQSLLHSNGYNYLDWYLQKPGQSPQLLIYLGSNRASGVPDRFSGSGSGTD

FTLKISRVEAEDVGVYYCMQALQTRTFGQGTKVEIKRTGGGGSGGGGSGG

GGSGGGGSEVQLLESGGGLVQPGGSLRLSCAASGFTFSGYIMAWVRQAPG

KGLEWVSYIYPSGGITVYADSVKGRFTISRDNSKNTLYLQMNSLRAEDTA

VYYCTRQRYRGPKYYYYMDVWGKGTTVTVSS

Bispecific antibody clone X0121-E01 Heavy
Chain-ScFv Fusion (SEQ ID NO: 17):
MGWSCIILFLVATATGAHSEVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSEVQLLESGGGLVQPGGSLRLSCAAS

GFTFSGYIMAWVRQAPGKGLEWVSYIYPSGGITVYADSVKGRFTISRDNS

KNTLYLQMNSLRAEDTAVYYCTRQRYRGPKYYYYMDVWGKGTTVTVSSGG

GGSGGGGSGGGGSGGGGSDIQMTQSPLSLPVTPGEPASISCRSSQSLLHS

NGYNYLDWYLQKPGQSPQIMIYLGSNRASGVPDRFSGSGSGTDFTLKISR

VEAEDVGVYYCMQALQTPRTFGQGTKVEIKR

Bispecific antibody clone X0121-G01 Heavy
Chain-ScFv Fusion (SEQ ID NO: 18):
*MGWSCIILFLVATATGAHS*EVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSDIQMTQSPLSLPVTPGEPASISCRS

SQSLLHSNGYNYLDWYLQKPGQSPQIMIYLGSNRASGVPDRFSGSGSGTD

FTLKISRVEAEDVGVYYCMQALQTPRTFGQGTKVEIKRTGGGGSGGGGSG

GGGSGGGGSEVQLLESGGGLVQPGGSLRLSCAASGFTFSGYIMAWVRQAP

GKGLEWVSYIYPSGGITVYADSVKGRFTISRDNSKNTLYLQMNSLRAEDT

AVYYCTRQRYRGPKYYYYMDVWGKGTTVTVSS

Bispecific antibody clone X0122-A01 Heavy
Chain-ScFv Fusion (SEQ ID NO: 19):
*MGWSCIILFLVATATGAHS*EVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSEVQLLESGGGLVQPGGSLRLSCAAS

GFTFSGYIMAWVRQAPGKGLEWVSYIYPSGGITVYADSVKGRFTISRDNS

KNTLYLQMNSLRAEDTAVYYCTRQRYRGPKYYYYMDVWGKGTTVTVSSGG

GGSGGGGSGGGGSGGGGSDIQMTQSPLSLPVTPGEPASISCRSSQSLLHS

NGYNYLDWYLQKPGQSPQLLIYLGSNRASGVPDRFSGSGSGTDFTLKISR

VEAEDVGVYYCMQALQTPWTFGQGTKVEIKR

Bispecific antibody clone X0122-C01 Heavy
Chain-ScFv Fusion (SEQ ID NO: 20):
*MGWSCIILFLVATATGAHS*EVQLLESGGGLVQPGGSLRLSCAASGFTFSH

YIMMWVRQAPGKGLEWVSGIYSSGGITVYADSVKGRFTISRDNSKNTLYL

QMNSLRAEDTAVYYCAYRRIGVPRRDEFDIWGQGTMVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKRVEPKSCDTHTCP

PCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKA

LPAPIEKTISKAKGQPREPQVYTLPPSREEMTKNQVSLTCLVKGFYPSDI

AVEWESNGQPENNYKTTPPVLDSDGSFFLYSKLTVDKSRWQQGNVFSCSV

MHEALHNHYTQKSLSLSPGKSGGGSDIQMTQSPLSLPVTPGEPASISCRS

SQSLLHSNGYNYLDWYLQKPGQSPQLLIYLGSNRASGVPDRFSGSGSGTD

FTLKISRVEAEDVGVYYCMQALQTPWTFGQGTKVEIKRTGGGGSGGGGSG

GGGSGGGGSEVQLLESGGGLVQPGGSLRLSCAASGFTFSGYIMAWVRQAP

GKGLEWVSYIYPSGGITVYADSVKGRFTISRDNSKNTLYLQMNSLRAEDT

AVYYCTRQRYRGPKYYYYMDVWGKGTTVTVSS

To construct the expression cassette for the exemplary hi specific antibodies described above, the coding sequences for the heavy and light chains of DX-2930 were cloned into a pRh1-CHO vector, modified with a C-terminal SGGGS linker that connects to the scFv coding sequence. The linker region contained a BamHI restriction site for efficient cloning of the scFvs. Five anti-Factor XIIa clones were selected for insertion into the construct via BamHI/XbaI restriction sites.

The italicized portions of the sequences provided above refer to the signal peptides. The anti-pKal portion of the bispecific antibody disclosed herein may include the same signal peptides, or may have the signal peptides removed or replaced with a different signal peptide. Signal peptides for use in producing secretory proteins are well known in the art.

The nucleotide sequences encoding the bispecific antibodies (in cis-tronic operon format) are provided below:

X0120-A01

(SEQ ID NO: 24)
ATGGGATGGTCCTGCATCATCCTGTTTCTGGTGGCTACAGCCACAGGCGT

GCACTCCGACATCCAGATGACCCAGTCCCCCTCCACCCTGTCCGCCTCTG

TGGGCGACAGAGTGACCATCACCTGTCGGGCCTCCCAGTCCATCTCCAGC

TGGCTGGCCTGGTATCAGCAGAAGCCCGGCAAGGCCCCCAAGCTGCTGAT

CTACAAGGCCAGCACCCTGGAATCCGGCGTGCCCTCCAGATTCTCCGGCT

CTGGCTCCGGCACCGAGTTCACCCTGACCATCAGCTCCCTGCAGCCCGAC

GACTTCGCCACCTACTACTGCCAGCAGTACAACACCTACTGGACCTTCGG

CCAGGGCACCAAGGTGGAAATCAAGCGGACCGTGGCCGCTCCCTCCGTGT

TCATCTTCCCACCCTCCGACGAGCAGCTGAAGTCCGGCACCGCCTCCGTG

GTCTGCCTGCTGAACAACTTCTACCCCCGCGAGGCCAAGGTGCAGTGGAA

GGTGGACAACGCCCTGCAGTCCGGCAACTCCCAGGAATCCGTGACCGAGC

AGGACTCCAAGGACAGCACCTACTCCCTGTCCTCTACCCTGACCCTGTCC

AAGGCCGACTACGAGAAGCACAAGGTGTACGCCTGCGAAGTGACCCACCA

GGGCCTGTCCAGCCCCGTGACCAAGTCCTTCAACCGGGGCGAGTGCTGAT

GAGGCGCGCCTTCGCGTCGAGCATGCATCTAGGGCGGCCAATTCCGCCCC

TCTCCCCCCCCCCCCTAACGTTACTGGCCGAAGCCGCTTGGAATAAGGC

CGGTGTGCGTTTGTCTATATGTTATTTTCCACCATATTGCCGTCTTTTGG

-continued

CAATGTGAGGGCCCGGAAACCTGGCCCTGTCTTCTTGACGAGCATTCCTA

GGGGTCTTTCCCCTCTCGCCAAAGGAATGCAAGGTCTGTTGAATGTCGTG

AAGGAAGCAGTTCCTCTGGAAGCTTCTTGAAGACAAACAACGTCTGTAGC

GACCCTTTGCAGGCAGCGGAACCCCCCACCTGGCGACAGGTGCCTCTGCG

GCCAAAAGCCACGTGTATAAGATACACCTGCAAAGGCGGCACAACCCCAG

TGCCACGTTGTGAGTTGGATAGTTGTGGAAAGAGTCAAATGGCTCTCTTC

AAGCGTATTCAACAAGGGGCTGAAGGATGCCCAGAAGGTACCCCATTGTA

TGGGATCTGATCTGGGGCCTCGGTGCAGATGCTTTACATGTGTTTAGTCG

AGGTTAAAAAAACGTCTAGGCCCCCCGAACCACGGGGACGTGGTTTTCCT

TTGAAAAACACGATGATAATATGGCCACAACCATGGGATGGTCCTGCATC

ATCCTGTTTCTGGTGGCCACAGCCACAGGCGCTCACTCCGAGGTGCAATT

GCTGGAATCCGGCGGAGGACTGGTGCAGCCTGGCGGCTCCCTGAGACTGT

CTTGCGCCGCCTCCGGCTTCACCTTCTCCCACTACATCATGATGTGGGTG

CGACAGGCTCCTGGCAAGGGGCTGGAATGGGTGTCCGGCATCTACTCCTC

CGGCGGCATCACCGTGTACGCCGACTCCGTGAAGGGCCGGTTCACCATCT

CTCGGGACAACTCCAAGAACACCCTGTACCTGCAGATGAACTCCCTGCGG

GCCGAGGACACCGCCGTGTACTACTGCGCCTACCGGCGGATCGGCGTGCC

CAGACGGGACGAGTTCGACATCTGGGGGCAGGGCACCATGGTGACAGTGT

CCTCCGCCTCCACCAAGGGCCCCTCTGTGTTCCCGCTAGCACCCTCCAGC

AAGTCCACCTCCGGCGGCACCGCTGCTCTGGGCTGCCTCGTCAAGGACTA

CTTCCCCGAGCCCGTGACCGTGTCCTGGAACTCTGGCGCCCTGACCAGCG

GAGTGCATACCTTCCCTGCCGTGCTCCAGTCCTCCGGCCTGTACAGCCTG

TCCTCTGTCGTGACCGTGCCCTCCAGCTCCCTGGGCACCCAGACCTACAT

CTGCAACGTGAACCACAAGCCCTCCAACACCAAAGTGGACAAGCGGGTGG

AACCCAAGTCCTGCGACACCCACACCTGTCCCCCTTGCCCTGCCCCTGAA

CTGCTGGGCGGACCCAGCGTGTTCCTGTTCCCCCCAAAGCCCAAGGACAC

CCTGATGATCTCCCGGACCCCCGAAGTGACCTGCGTGGTGGTGGACGTGT

CCCACGAGGACCCTGAAGTGAAGTTTAATTGGTACGTGGACGGCGTGGAA

GTGCATAACGCCAAGACCAAGCCCAGAGAGGAACAGTACAACTCCACCTA

CCGGGTGGTGTCCGTGCTGACCGTGCTGCACCAGGACTGGCTGAACGGCA

AAGAGTACAAGTGCAAGGTGTCCAACAAGGCCCTGCCTGCCCCCATCGAA

AAGACCATCAGCAAGGCCAAGGGCCAGCCTCGCGAGCCCCAGGTGTACAC

CCTGCCCCCTAGCCGGGAAGAGATGACCAAGAACCAGGTGTCCCTGACCT

GTCTGGTCAAGGGCTTCTACCCCTCCGATATCGCCGTGGAATGGGAGTCC

AACGGCCAGCCCGAGAACAACTACAAGACCACCCCCCCTGTGCTGGACAG

CGACGGCTCATTCTTCCTGTACTCCAAGCTGACCGTGGACAAGTCCCGGT

GGCAGCAGGGCAACGTGTTCTCCTGCTCCGTGATGCACGAGGCCCTGCAC

AACCACTACACCCAGAAGTCCCTGTCCCTGTCTCCCGGCAAGTCTGGCGG

AGGATCCGAAGTGCAGCTGCTGGAAAGCGGCGGAGGCCTGGTGCAGCCTG

GAGGCAGCCTGAGACTGTCTTGCGCTGCCAGCGGCTTCACCTTCAGCTTC

TACAGCATGCACTGGGTCCGACAGGCTCCAGGCAAGGGCCTGGAATGGGT

-continued

GTCCCGGATCTACCCCTCTGGCGGCGTGACCAAATACGCCGACAGCGTGA

AGGGCCGGTTCACCATCAGCCGGGACAACAGCAAGAACACCCTGTACCTG

CAGATGAACAGCCTGCGGGCCGAGGACACCGCCGTGTACTACTGCACCCG

GCAGCGGTACAGAGGCCCCAAGTACTACTACTACATGGACGTGTGGGGCA

AGGGCACAACCGTGACCGTGTCTAGCGGAGGCGGAGGATCTGGCGGAGGT

GGAAGTGGTGGTGGCGGAAGTGGCGGAGGCGGCAGCGACATCCAGATGAC

CCAGAGCCCCCTGAGCCTGCCCGTGACACCTGGCGAGCCTGCCAGCATCA

GCTGCAGAAGCAGCCAGAGCCTGCTGCACAGCAACGGCTACAACTACCTG

GACTGGTATCTGCAGAAGCCCGGCCAGTCCCCCCAGCTGCTGATCTACCT

GGGCAGCAACAGAGCCAGCGGCGTGCCCGACAGATTCAGCGGCAGCGGCT

CCGGCACCGACTTCACCCTGAAGATCAGCCGGGTGGAAGCCGAGGACGTG

GGCGTGTACTATTGCATGCAGGCCCTGCAGACCCCCTGGACCTTCGGCCA

GGGCACCAAGGTGGAAATCAAGAGATGAATCTAGA

X0120-C01

(SEQ ID NO: 25)

ATGGGATGGTCCTGCATCATCCTGTTTCTGGTGGCTACAGCCACAGGCGT

GCACTCCGACATCCAGATGACCCAGTCCCCCTCCACCCTGTCCGCCTCTG

TGGGCGACAGAGTGACCATCACCTGTCGGGCCTCCCAGTCCATCTCCAGC

TGGCTGGCCTGGTATCAGCAGAAGCCGGCAAGGCCCCCAAGCTGCTGAT

CTACAAGGCCAGCACCCTGGAATCCGGCGTGCCCTCCAGATTCTCCGGCT

CTGGCTCCGGCACCGAGTTCACCCTGACCATCAGCTCCCTGCAGCCCGAC

GACTTCGCCACCTACTACTGCCAGCAGTACAACACCTACTGGACCTTCGG

CCAGGGCACCAAGGTGGAAATCAAGCGGACCGTGGCCGCTCCCTCCGTGT

TCATCTTCCCACCCTCCGACGAGCAGCTGAAGTCCGGCACCGCCTCCGTG

GTCTGCCTGCTGAACAACTTCTACCCCCGCGAGGCCAAGGTGCAGTGGAA

GGTGGACAACGCCCTGCAGTCCGGCAACTCCCAGGAATCCGTGACCGAGC

AGGACTCCAAGGACAGCACCTACTCCCTGTCCTCTACCCTGACCCTGTCC

AAGGCCGACTACGAGAAGCACAAGGTGTACGCCTGCGAAGTGACCCACCA

GGGCCTGTCCAGCCCCGTGACCAAGTCCTTCAACCGGGGCGAGTGCTGAT

GAGGCGCGCCTTCGCGTCGAGCATGCATCTAGGGCGGCCAATTCCGCCCC

TCTCCCCCCCCCCCCTAACGTTACTGGCCGAAGCCGCTTGGAATAAGGC

CGGTGTGCGTTTGTCTATATGTTATTTTCCACCATATTGCCGTCTTTTGG

CAATGTGAGGGCCCGGAAACCTGGCCCTGTCTTCTTGACGAGCATTCCTA

GGGGTCTTTCCCCTCTCGCCAAAGGAATGCAAGGTCTGTTGAATGTCGTG

AAGGAAGCAGTTCCTCTGGAAGCTTCTTGAAGACAAACAACGTCTGTAGC

GACCCTTTGCAGGCAGCGGAACCCCCCACCTGGCGACAGGTGCCTCTGCG

GCCAAAAGCCACGTGTATAAGATACACCTGCAAAGGCGGCACAACCCCAG

TGCCACGTTGTGAGTTGGATAGTTGTGGAAAGAGTCAAATGGCTCTCTTC

AAGCGTATTCAACAAGGGGCTGAAGGATGCCCAGAAGGTACCCCATTGTA

TGGGATCTGATCTGGGGCCTCGGTGCAGATGCTTTACATGTGTTTAGTCG

AGGTTAAAAAAACGTCTAGGCCCCCCGAACCACGGGGACGTGGTTTTCCT

-continued

TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGGCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGACATCCAGATGACCCAGAGCCCCCTGAGCCTGCCCGTGACAC
CTGGCGAGCCTGCCAGCATCAGCTGCAGAAGCAGCCAGAGCCTGCTGCAC
AGCAACGGCTACAACTACCTGGACTGGTATCTGCAGAAGCCCGGCCAGTC
CCCCCAGCTGCTGATCTACCTGGGCAGCAACAGAGCCAGCGGCGTGCCCG
ACAGATTCAGCGGCAGCGGCTCCGGCACCGACTTCACCCTGAAGATCAGC
CGGGTCGAAGCCGAGGACGTGGGCGTGTACTACTGCATGCAGGCCCTGCA
GACCCCCTGGACCTTCGGCCAGGGCACCAAGGTGGAAATCAAGCGGACAG
GCGGCGGAGGCTCTGGCGGAGGTGGAAGCGGAGGCGGAGGAAGTGGCGGA
GGCGGCTCTGAGGTGCAGCTGCTGGAATCTGGAGGCGGACTGGTGCAGCC
TGGCGGCAGCCTGAGACTGTCTTGCGCTGCCAGCGGCTTCACCTTCAGCT
TCTACAGCATGCACTGGGTCCGACAGGCCCCTGGCAAGGGCCTGGAATGG
GTGTCCCGGATCTACCCCTCTGGCGGCGTGACCAAATACGCCGACAGCGT

-continued

GAAGGGCCGGTTCACCATCAGCCGGGACAACAGCAAGAACACCCTGTACC
TGCAGATGAACAGCCTGCGGGCCGAGGACACCGCCGTGTACTATTGCACC
CGGCAGCGGTACAGAGGCCCCAAGTACTACTACTACATGGACGTGTGGGG
CAAGGGCACCACCGTGACCGTGTCCAGCTGAATCTAGA

X0120-E01

(SEQ ID NO: 26)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA
GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG
TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGGCAGGGCACCATGGTGACAGTGT

-continued

CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGAAGTGCAGCTGCTGGAAAGCGGCGGAGGACTGGTGCAGCCTG
GCGGCTCCCTGAGACTGTCTTGCGCCGCCAGCGGCTTCACCTTCAGCGGC
TACATCATGGCCTGGGTCCGACAGGCTCCAGGCAAGGGCCTGGAATGGGT
GTCCTACATCTACCCCAGCGGCGGCATCACCGTGTACGCCGACAGCGTGA
AGGGCCGGTTCACCATCAGCCGGGACAACAGCAAGAACACCCTGTACCTG
CAGATGAACAGCCTGCGGGCCGAGGACACCGCCGTGTACTACTGCACCCG
GCAGCGGTACAGAGGCCCCAAGTACTACTACTACATGGACGTGTGGGGCA
AGGGCACCACCGTGACCGTGTCTAGCGGAGGCGGAGGATCTGGCGGAGGT
GGAAGTGGTGGTGGCGGAAGTGGCGGCGGAGGCAGCGACATCCAGATGAC
CCAGAGCCCCCTGAGCCTGAGCGTGGCACCTGGCGAGCCTGCCAGCATCA
GCTGCAGAAGCAGCCAGAGCCTGCTGCACCGGAACGGCCACAACTACCTG
GACTGGTATCTGCAGAAGCCCGGCCAGTCCCCCCAGCTGCTGATCTACCT
GGGCAGCAACAGAGCCAGCGGCGTGCCCGAGAGATTCAGCGGCAGCGGCT
CCGGCACCGACTTCACCCTGCGGATCAGCCGGGTGGAAGCCGAGGACGTG
GGCGTGTACTATTGCATGCAGGCTCTGCAGGCCAGAACCTTCGGCCAGGG
CACCAAGGTGGAAATCAAGAGATGAATCTAGA

X0120-G01

(SEQ ID NO: 27)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT

-continued

CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA
GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG
TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGGCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT

-continued

CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGACATCCAGATGACCCAGAGCCCCCTGAGCCTGAGCGTGGCAC
CTGGCGAGCCTGCCAGCATCAGCTGCAGAAGCAGCCAGAGCCTGCTGCAC
CGGAACGGCCACAACTACCTGGACTGGTATCTGCAGAAGCCCGGCCAGTC
CCCCCAGCTGCTGATCTACCTGGGCAGCAACAGAGCCAGCGGCGTGCCCG
AGAGATTCAGCGGCAGCGGCTCCGGCACCGACTTCACCCTGCGGATCAGC
CGGGTCGAAGCCGAGGACGTGGGCGTGTACTACTGCATGCAGGCTCTGCA
GGCCAGAACCTTCGGCCAGGGCACCAAGGTGGAAATCAAGCGGACAGGCG
GCGGAGGCTCTGGCGGAGGTGGAAGCGGAGGCGGAGGAAGTGGCGGAGGC
GGCTCTGAGGTGCAGCTGCTGGAATCTGGCGGCGGACTGGTGCAGCCTGG
CGGCAGCCTGAGACTGTCTTGCGCCGCCAGCGGCTTCACCTTCAGCGGCT
ACATCATGGCCTGGGTCCGACAGGCCCCTGGCAAGGGCCTGGAATGGGTG
TCCTACATCTACCCCAGCGGCGGCATCACCGTGTACGCCGACAGCGTGAA
GGGCCGGTTCACCATCAGCCGGGACAACAGCAAGAACACCCTGTACCTGC
AGATGAACAGCCTGCGGGCCGAGGACACCGCCGTGTACTATTGCACCCGG
CAGCGGTACAGAGGCCCCAAGTACTACTACTACATGGACGTGTGGGGCAA
GGGCACCACCGTGACCGTGTCCAGCTGAATCTAGA

X0121-A03
(SEQ ID NO: 28)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA

-continued

GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG
TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT

-continued

GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGAAGTGCAGCTGCTGGAAAGCGGCGGAGGACTGGTGCAGCCTG
GAGGCAGCCTGAGACTGTCTTGCGCCGCCAGCGGCTTCACCTTCAGCGGC
TACATCATGGCCTGGGTCCGACAGGCTCCAGGCAAGGGCCTGGAATGGGT
GTCCTACATCTACCCCAGCGGCGGCATCACCGTGTACGCCGACAGCGTGA
AGGGCCGGTTCACCATCAGCCGGGACAACAGCAAGAACACCCTGTACCTG
CAGATGAACAGCCTGCGGGCCGAGGACACCGCCGTGTACTACTGCACCCG
GCAGCGGTACAGAGGCCCCAAGTACTACTACTACATGGACGTGTGGGGCA
AGGGCACCACCGTGACCGTGTCTAGCGGAGGCGGAGGATCTGGCGGAGGT
GGAAGTGGTGGTGGCGGAAGTGGCGGCGGAGGCAGCGACATCCAGATGAC
CCAGAGCCCCCTGAGCCTGCCCGTGACACCTGGCGAGCCTGCCAGCATCA
GCTGCAGAAGCAGCCAGAGCCTGCTGCACAGCAACGGCTACAACTACCTG
GACTGGTATCTGCAGAAGCCCGGCCAGTCCCCCCAGCTGCTGATCTACCT
GGGCAGCAACAGAGCCAGCGGCGTGCCCGACAGATTCAGCGGCAGCGGCT
CCGGCACCGACTTCACCCTGAAGATCAGCCGGGTGGAAGCCGAGGACGTG
GGCGTGTACTATTGCATGCAGGCCCTGCAGACCCGGACCTTCGGCCAGGG
CACCAAGGTGGAAATCAAGAGATGAATCTAGA

X0121-C01

(SEQ ID NO: 29)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA
GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG

-continued

TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGACATCCAGATGACCCAGAGCCCCCTGAGCCTGCCCGTGACAC
CTGGCGAGCCTGCCAGCATCAGCTGCAGAAGCAGCCAGAGCCTGCTGCAC
AGCAACGGCTACAACTACCTGGACTGGTATCTGCAGAAGCCCGGCCAGTC
CCCCCAGCTGCTGATCTACCTGGGCAGCAACAGAGCCAGCGGCGTGCCCG
ACAGATTCAGCGGCAGCGGCTCCGGCACCGACTTCACCCTGAAGATCAGC
CGGGTCGAAGCCGAGGACGTGGGCGTGTACTACTGCATGCAGGCCCTGCA
GACCCGGACCTTCGGCCAGGGCACCAAGGTGGAAATCAAGCGGACAGGCG

GCGGAGGCTCTGGCGGAGGTGGAAGCGGAGGCGGAGGAAGTGGCGGAGGC
GGCTCTGAGGTGCAGCTGCTGGAATCTGGCGGCGGACTGGTGCAGCCTGG
CGGCAGCCTGAGACTGTCTTGCGCCGCCAGCGGCTTCACCTTCAGCGGCT
ACATCATGGCCTGGGTCCGACAGGCCCCTGGCAAGGGCCTGGAATGGGTG
TCCTACATCTACCCCAGCGGCGGCATCACCGTGTACGCCGACAGCGTGAA
GGGCCGGTTCACCATCAGCCGGGACAACAGCAAGAACACCCTGTACCTGC
AGATGAACAGCCTGCGGGCCGAGGACACCGCCGTGTACTATTGCACCCGG
CAGCGGTACAGAGGCCCCAAGTACTACTACTACATGGACGTGTGGGGCAA
GGGCACCACCGTGACCGTGTCCAGCTGAATCTAGA

X0121-E01

(SEQ ID NO: 30)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA
GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG
TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC

CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGCCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT
CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGAAGTGCAGCTGCTGGAAAGCGGCGGAGGACTGGTGCAGCCTG
GAGGCAGCCTGAGACTGTCTTGCGCCGCCAGCGGCTTCACCTTCAGCGGC
TACATCATGGCCTGGGTCCGACAGGCTCCAGGCAAGGGCCTGGAATGGGT
GTCCTACATCTACCCCAGCGGCGGCATCACCGTGTACGCCGACAGCGTGA
AGGGCCGGTTCACCATCAGCCGGGACAACAGCAAGAACACCCTGTACCTG
CAGATGAACAGCCTGCGGGCCGAGGACACCGCCGTGTACTACTGCACCCG
GCAGCGGTACAGAGGCCCCAAGTACTACTACTACATGGACGTGTGGGGCA
AGGGCACCACCGTGACCGTGTCTAGCGGAGGCGGAGGATCTGGCGGAGGT
GGAAGTGGTGGTGGCGGAAGTGGCGGCGGAGGCAGCGACATCCAGATGAC
CCAGAGCCCCCTGAGCCTGCCCGTGACACCTGGCGAGCCTGCCAGCATCA
GCTGCAGAAGCAGCCAGAGCCTGCTGCACAGCAACGGCTACAACTACCTG
GACTGGTATCTGCAGAAGCCCGGCCAGTCCCCCCAGATCATGATCTACCT
GGGCAGCAACAGAGCCAGCGGCGTGCCCGACAGATTCAGCGGCAGCGGCT
CCGGCACCGACTTCACCCTGAAGATCAGCCGGGTGGAAGCCGAGGACGTG
GGCGTGTACTATTGCATGCAGGCCCTGCAGACCCCCAGAACCTTCGGCCA
GGGCACCAAGGTGGAAATCAAGAGATGAATCTAGA

X0121-G01
(SEQ ID NO: 31)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT
TCATCTTCCCACCCTCCGACGAGCAGCTGAAGTCCGGCACCGCCTCCGTG
GTCTGCCTGCTGAACAACTTCTACCCCCGCGAGGCCAAGGTGCAGTGGAA
GGTGGACAACGCCCTGCAGTCCGGCAACTCCCAGGAATCCGTGACCGAGC
AGGACTCCAAGGACAGCACCTACTCCCTGTCCTCTACCCTGACCCTGTCC
AAGGCCGACTACGAGAAGCACAAGGTGTACGCCTGCGAAGTGACCCACCA
GGGCCTGTCCAGCCCCGTGACCAAGTCCTTCAACCGGGGCGAGTGCTGAT
GAGGCGCGCCTTCGCGTCGAGCATGCATCTAGGGCGGCCAATTCCGCCCC
TCTCCCCCCCCCCCCTAACGTTACTGGCCGAAGCCGCTTGGAATAAGGC
CGGTGTGCGTTTGTCTATATGTTATTTTCCACCATATTGCCGTCTTTTGG
CAATGTGAGGGCCCGGAAACCTGGCCCTGTCTTCTTGACGAGCATTCCTA
GGGGTCTTTCCCCTCTCGCCAAAGGAATGCAAGGTCTGTTGAATGTCGTG
AAGGAAGCAGTTCCTCTGGAAGCTTCTTGAAGACAAACAACGTCTGTAGC
GACCCTTTGCAGGCAGCGGAACCCCCCACCTGGCGACAGGTGCCTCTGCG
GCCAAAAGCCACGTGTATAAGATACACCTGCAAAGGCGGCACAACCCCAG
TGCCACGTTGTGAGTTGGATAGTTGTGGAAAGAGTCAAATGGCTCTCTTC
AAGCGTATTCAACAAGGGGCTGAAGGATGCCCAGAAGGTACCCCATTGTA
TGGGATCTGATCTGGGGCCTCGGTGCAGATGCTTTACATGTGTTTAGTCG
AGGTTAAAAAAACGTCTAGGCCCCCCGAACCACGGGGACGTGGTTTTCCT
TTGAAAAACACGATGATAATATGGCCACAACCATGGGATGGTCCTGCATC
ATCCTGTTTCTGGTGGCCACAGCCACAGGCGCTCACTCCGAGGTGCAATT
GCTGGAATCCGGCGGAGGACTGGTGCAGCCTGGCGGCTCCCTGAGACTGT
CTTGCGCCGCCTCCGGCTTCACCTTCTCCCACTACATCATGATGTGGGTG
CGACAGGCTCCTGGCAAGGGGCTGGAATGGGTGTCCGGCATCTACTCCTC
CGGCGGCATCACCGTGTACGCCGACTCCGTGAAGGGCCGGTTCACCATCT
CTCGGGACAACTCCAAGAACACCCTGTACCTGCAGATGAACTCCCTGCGG
GCCGAGGACACCGCCGTGTACTACTGCGCCTACCGGCGGATCGGCGTGCC
CAGACGGGACGAGTTCGACATCTGGGGCAGGGCACCATGGTGACAGTGT
CCTCCGCCTCCACCAAGGGCCCCTCTGTGTTCCCGCTAGCACCCTCCAGC
AAGTCCACCTCCGGCGGCACCGCTGCTCTGGGCTGCCTCGTCAAGGACTA
CTTCCCCGAGCCCGTGACCGTGTCCTGGAACTCTGGCGCCCTGACCAGCG
GAGTGCATACCTTCCCTGCCGTGCTCCAGTCCTCCGGCCTGTACAGCCTG
TCCTCTGTCGTGACCGTGCCCTCCAGCTCCCTGGGCACCCAGACCTACAT

CTGCAACGTGAACCACAAGCCCTCCAACACCAAAGTGGACAAGCGGGTGG
AACCCAAGTCCTGCGACACCCACACCTGTCCCCCTTGCCCTGCCCCTGAA
CTGCTGGGCGGACCCAGCGTGTTCCTGTTCCCCCCAAAGCCCAAGGACAC
CCTGATGATCTCCCGGACCCCCGAAGTGACCTGCGTGGTGGTGGACGTGT
CCCACGAGGACCCTGAAGTGAAGTTTAATTGGTACGTGGACGGCGTGGAA
GTGCATAACGCCAAGACCAAGCCCAGAGAGGAACAGTACAACTCCACCTA
CCGGGTGGTGTCCGTGCTGACCGTGCTGCACCAGGACTGGCTGAACGGCA
AAGAGTACAAGTGCAAGGTGTCCAACAAGGCCCTGCCTGCCCCCATCGAA
AAGACCATCAGCAAGGCCAAGGGCCAGCCTCGCGAGCCCCAGGTGTACAC
CCTGCCCCCTAGCCGGGAAGAGATGACCAAGAACCAGGTGTCCCTGACCT
GTCTGGTCAAGGGCTTCTACCCCTCCGATATCGCCGTGGAATGGGAGTCC
AACGGCCAGCCCGAGAACAACTACAAGACCACCCCCCCTGTGCTGGACAG
CGACGGCTCATTCTTCCTGTACTCCAAGCTGACCGTGGACAAGTCCCGGT
GGCAGCAGGGCAACGTGTTCTCCTGCTCCGTGATGCACGAGGCCCTGCAC
AACCACTACACCCAGAAGTCCCTGTCCCTGTCTCCCGGCAAGTCTGGCGG
AGGATCCGACATCCAGATGACCCAGAGCCCCTGAGCCTGCCCGTGACAC
CTGGCGAGCCTGCCAGCATCAGCTGCAGAAGCAGCCAGAGCCTGCTGCAC
AGCAACGGCTACAACTACCTGGACTGGTATCTGCAGAAGCCCGGCCAGTC
CCCCCAGATCATGATCTACCTGGGCAGCAACAGAGCCAGCGGCGTGCCCG
ACAGATTCAGCGGCAGCGGCTCCGGCACCGACTTCACCCTGAAGATCAGC
CGGGTCGAAGCCGAGGACGTGGGCGTGTACTACTGCATGCAGGCCCTGCA
GACCCCAGAACCTTCGGCCAGGGCACCAAGGTGGAAATCAAGCGGACAG
GCGGCGGAGGCTCTGGCGGAGGTGGAAGCGGAGGCGGAGGAAGTGGCGGA
GGCGGCTCTGAGGTGCAGCTGCTGGAATCTGGCGGCGGACTGGTGCAGCC
TGGCGGCAGCCTGAGACTGTCTTGCGCCGCCAGCGGCTTCACCTTCAGCG
GCTACATCATGGCCTGGGTCCGACAGGCCCCTGGCAAGGGCCTGGAATGG
GTGTCCTACATCTACCCCAGCGGCGGCATCACCGTGTACGCCGACAGCGT
GAAGGGCCGGTTCACCATCAGCCGGGACAACAGCAAGAACACCCTGTACC
TGCAGATGAACAGCCTGCGGGCCGAGGACACCGCCGTGTACTATTGCACC
CGGCAGCGGTACAGAGGCCCCAAGTACTACTACTACATGGACGTGTGGGG
CAAGGGCACCACCGTGACCGTGTCCAGCTGAATCTAGA

X0122-A01
(SEQ ID NO: 32)
ATGGGATGGTCCTGCATCATCCTGTTTCTGGTGGCTACAGCCACAGGCGT
GCACTCCGACATCCAGATGACCCAGTCCCCCTCCACCCTGTCCGCCTCTG
TGGGCGACAGAGTGACCATCACCTGTCGGGCCTCCCAGTCCATCTCCAGC
TGGCTGGCCTGGTATCAGCAGAAGCCCGGCAAGGCCCCCAAGCTGCTGAT
CTACAAGGCCAGCACCCTGGAATCCGGCGTGCCCTCCAGATTCTCCGGCT
CTGGCTCCGGCACCGAGTTCACCCTGACCATCAGCTCCCTGCAGCCCGAC
GACTTCGCCACCTACTACTGCCAGCAGTACAACACCTACTGGACCTTCGG
CCAGGGCACCAAGGTGGAAATCAAGCGGACCGTGGCCGCTCCCTCCGTGT

-continued
```
TCATCTTCCCACCCTCCGACGAGCAGCTGAAGTCCGGCACCGCCTCCGTG

GTCTGCCTGCTGAACAACTTCTACCCCCGCGAGGCCAAGGTGCAGTGGAA

GGTGGACAACGCCCTGCAGTCCGGCAACTCCCAGGAATCCGTGACCGAGC

AGGACTCCAAGGACAGCACCTACTCCCTGTCCTCTACCCTGACCCTGTCC

AAGGCCGACTACGAGAAGCACAAGGTGTACGCCTGCGAAGTGACCCACCA

GGGCCTGTCCAGCCCCGTGACCAAGTCCTTCAACCGGGGCGAGTGCTGAT

GAGGCGCGCCTTCGCGTCGAGCATGCATCTAGGGCGGCCAATTCCGCCCC

TCTCCCCCCCCCCCCCTAACGTTACTGGCCGAAGCCGCTTGGAATAAGGC

CGGTGTGCGTTTGTCTATATGTTATTTTCCACCATATTGCCGTCTTTTGG

CAATGTGAGGGCCCGGAAACCTGGCCCTGTCTTCTTGACGAGCATTCCTA

GGGGTCTTTCCCCTCTCGCCAAAGGAATGCAAGGTCTGTTGAATGTCGTG

AAGGAAGCAGTTCCTCTGGAAGCTTCTTGAAGACAAACAACGTCTGTAGC

GACCCTTTGCAGGCAGCGGAACCCCCCACCTGGCGACAGGTGCCTCTGCG

GCCAAAAGCCACGTGTATAAGATACACCTGCAAAGGCGGCACAACCCCAG

TGCCACGTTGTGAGTTGGATAGTTGTGGAAAGAGTCAAATGGCTCTCTTC

AAGCGTATTCAACAAGGGGCTGAAGGATGCCCAGAAGGTACCCCATTGTA

TGGGATCTGATCTGGGGCCTCGGTGCAGATGCTTTACATGTGTTTAGTCG

AGGTTAAAAAAACGTCTAGGCCCCCCGAACCACGGGACGTGGTTTTCCT

TTGAAAAACACGATGATAATATGGCCACAACCATGGGATGGTCCTGCATC

ATCCTGTTTCTGGTGGCCACAGCCACAGGCGCTCACTCCGAGGTGCAATT

GCTGGAATCCGGCGGAGGACTGGTGCAGCCTGGCGGCTCCCTGAGACTGT

CTTGCGCCGCCTCCGGCTTCACCTTCTCCCACTACATCATGATGTGGGTG

CGACAGGCTCCTGGCAAGGGGCTGGAATGGGTGTCCGGCATCTACTCCTC

CGGCGGCATCACCGTGTACGCCGACTCCGTGAAGGGCCGGTTCACCATCT

CTCGGGACAACTCCAAGAACACCCTGTACCTGCAGATGAACTCCCTGCGG

GCCGAGGACACCGCCGTGTACTACTGCGCCTACCGGCGGATCGGCGTGCC

CAGACGGGACGAGTTCGACATCTGGGGGCAGGGCACCATGGTGACAGTGT

CCTCCGCCTCCACCAAGGGCCCCTCTGTGTTCCCGCTAGCACCCTCCAGC

AAGTCCACCTCCGGCGGCACCGCTGCTCTGGGCTGCCTCGTCAAGGACTA

CTTCCCCGAGCCCGTGACCGTGTCCTGGAACTCTGGCGCCCTGACCAGCG

GAGTGCATACCTTCCCTGCCGTGCTCCAGTCCTCCGGCCTGTACAGCCTG

TCCTCTGTCGTGACCGTGCCCTCCAGCTCCCTGGGCACCCAGACCTACAT

CTGCAACGTGAACCACAAGCCCTCCAACACCAAAGTGGACAAGCGGGTGG

AACCCAAGTCCTGCGACACCCACACCTGTCCCCCTTGCCCTGCCCCTGAA

CTGCTGGGCGGACCCAGCGTGTTCCTGTTCCCCCAAAGCCCAAGGACAC

CCTGATGATCTCCCGGACCCCCGAAGTGACCTGCGTGGTGGTGGACGTGT

CCCACGAGGACCCTGAAGTGAAGTTTAATTGGTACGTGGACGGCGTGGAA

GTGCATAACGCCAAGACCAAGCCCAGAGAGGAACAGTACAACTCCACCTA

CCGGGTGGTGTCCGTGCTGACCGTGCTGCACCAGGACTGGCTGAACGGCA

AAGAGTACAAGTGCAAGGTGTCCAACAAGGCCCTGCCTGCCCCCATCGAA

AAGACCATCAGCAAGGCCAAGGGCCAGCCTCGCGAGCCCCAGGTGTACAC
```

```
CCTGCCCCCTAGCCGGGAAGAGATGACCAAGAACCAGGTGTCCCTGACCT

GTCTGGTCAAGGGCTTCTACCCCTCCGATATCGCCGTGGAATGGGAGTCC

AACGGCCAGCCCGAGAACAACTACAAGACCACCCCCCCTGTGCTGGACAG

CGACGGCTCATTCTTCCTGTACTCCAAGCTGACCGTGGACAAGTCCCGGT

GGCAGCAGGGCAACGTGTTCTCCTGCTCCGTGATGCACGAGGCCCTGCAC

AACCACTACACCCAGAAGTCCCTGTCCCTGTCTCCCGGCAAGTCTGGCGG

AGGATCCGAAGTGCAGCTGCTGGAAAGCGGCGGAGGACTGGTGCAGCCTG

GAGGCAGCCTGAGACTGTCTTGCGCCGCCAGCGGCTTCACCTTCAGCGGC

TACATCATGGCCTGGGTCCGACAGGCTCCAGGCAAGGGCCTGGAATGGGT

GTCCTACATCTACCCCAGCGGCGGCATCACCGTGTACGCCGACAGCGTGA

AGGGCCGGTTCACCATCAGCCGGGACAACAGCAAGAACACCCTGTACCTG

CAGATGAACAGCCTGCGGGCCGAGGACACCGCCGTGTACTACTGCACCCG

GCAGCGGTACAGAGGCCCCAAGTACTACTACTACATGGACGTGTGGGGCA

AGGGCACCACCGTGACCGTGTCTAGCGGAGGCGGAGGATCTGGCGGAGGT

GGAAGTGGTGGTGGCGGAAGTGGCGGCGGAGGCAGCGACATCCAGATGAC

CCAGAGCCCCCTGAGCCTGCCCGTGACACCTGGCGAGCCTGCCAGCATCA

GCTGCAGAAGCAGCCAGAGCCTGCTGCACAGCAACGGCTACAACTACCTG

GACTGGTATCTGCAGAAGCCCGGCCAGTCCCCCCAGCTGCTGATCTACCT

GGGCAGCAACAGAGCCAGCGGCGTGCCCGACAGATTCAGCGGCAGCGGCT

CCGGCACCGACTTCACCCTGAAGATCAGCCGGGTGGAAGCCGAGGACGTG

GGCGTGTACTATTGCATGCAGGCCCTGCAGACCCCCTGGACCTTCGGCCA

GGGCACCAAGGTGGAAATCAAGAGATGAATCTAGA
```

X0122-C01

(SEQ ID NO: 33)
```
ATGGGATGGTCCTGCATCATCCTGTTTCTGGTGGCTACAGCCACAGGCGT

GCACTCCGACATCCAGATGACCCAGTCCCCCTCCACCCTGTCCGCCTCTG

TGGGCGACAGAGTGACCATCACCTGTCGGGCCTCCCAGTCCATCTCCAGC

TGGCTGGCCTGGTATCAGCAGAAGCCCGGCAAGGCCCCCAAGCTGCTGAT

CTACAAGGCCAGCACCCTGGAATCCGGCGTGCCCTCCAGATTCTCCGGCT

CTGGCTCCGGCACCGAGTTCACCCTGACCATCAGCTCCCTGCAGCCCGAC

GACTTCGCCACCTACTACTGCCAGCAGTACAACACCTACTGGACCTTCGG

CCAGGGCACCAAGGTGGAAATCAAGCGGACCGTGGCCGCTCCCTCCGTGT

TCATCTTCCCACCCTCCGACGAGCAGCTGAAGTCCGGCACCGCCTCCGTG

GTCTGCCTGCTGAACAACTTCTACCCCCGCGAGGCCAAGGTGCAGTGGAA

GGTGGACAACGCCCTGCAGTCCGGCAACTCCCAGGAATCCGTGACCGAGC

AGGACTCCAAGGACAGCACCTACTCCCTGTCCTCTACCCTGACCCTGTCC

AAGGCCGACTACGAGAAGCACAAGGTGTACGCCTGCGAAGTGACCCACCA

GGGCCTGTCCAGCCCCGTGACCAAGTCCTTCAACCGGGGCGAGTGCTGAT

GAGGCGCGCCTTCGCGTCGAGCATGCATCTAGGGCGGCCAATTCCGCCCC

TCTCCCCCCCCCCCCCTAACGTTACTGGCCGAAGCCGCTTGGAATAAGGC

CGGTGTGCGTTTGTCTATATGTTATTTTCCACCATATTGCCGTCTTTTGG
```

-continued
```
CAATGTGAGGGCCCGGAAACCTGGCCCTGTCTTCTTGACGAGCATTCCTA

GGGGTCTTTCCCCTCTCGCCAAAGGAATGCAAGGTCTGTTGAATGTCGTG

AAGGAAGCAGTTCCTCTGGAAGCTTCTTGAAGACAAACAACGTCTGTAGC

GACCCTTTGCAGGCAGCGGAACCCCCCACCTGGCGACAGGTGCCTCTGCG

GCCAAAAGCCACGTGTATAAGATACACCTGCAAAGGCGGCACAACCCCAG

TGCCACGTTGTGAGTTGGATAGTTGTGGAAAGAGTCAAATGGCTCTCTTC

AAGCGTATTCAACAAGGGGCTGAAGGATGCCCAGAAGGTACCCCATTGTA

TGGGATCTGATCTGGGGCCTCGGTGCAGATGCTTTACATGTGTTTAGTCG

AGGTTAAAAAAACGTCTAGGCCCCCCGAACCACGGGGACGTGGTTTTCCT

TTGAAAAACACGATGATAATATGGCCACAACCATGGGATGGTCCTGCATC

ATCCTGTTTCTGGTGGCCACAGCCACAGGCGCTCACTCCGAGGTGCAATT

GCTGGAATCCGGCGGAGGACTGGTGCAGCCTGGCGGCTCCCTGAGACTGT

CTTGCGCCGCCTCCGGCTTCACCTTCTCCCACTACATCATGATGTGGGTG

CGACAGGCTCCTGGCAAGGGGCTGGAATGGGTGTCCGGCATCTACTCCTC

CGGCGGCATCACCGTGTACGCCGACTCCGTGAAGGGCCGGTTCACCATCT

CTCGGGACAACTCCAAGAACACCCTGTACCTGCAGATGAACTCCCTGCGG

GCCGAGGACACCGCCGTGTACTACTGCGCCTACCGGCGGATCGGCGTGCC

CAGACGGGACGAGTTCGACATCTGGGGCAGGGCACCATGGTGACAGTGT

CCTCCGCCTCCACCAAGGGCCCCTCTGTGTTCCCGCTAGCACCCTCCAGC

AAGTCCACCTCCGGCGGCACCGCTGCTCTGGGCTGCCTCGTCAAGGACTA

CTTCCCCGAGCCCGTGACCGTGTCCTGGAACTCTGGCGCCCTGACCAGCG

GAGTGCATACCTTCCCTGCCGTGCTCCAGTCCTCCGGCCTGTACAGCCTG

TCCTCTGTCGTGACCGTGCCCTCCAGCTCCCTGGGCACCCAGACCTACAT

CTGCAACGTGAACCACAAGCCCTCCAACACCAAAGTGGACAAGCGGGTGG

AACCCAAGTCCTGCGACACCCACACCTGTCCCCCTTGCCCTGCCCCTGAA

CTGCTGGGCGGACCCAGCGTGTTCCTGTTCCCCCCAAAGCCCAAGGACAC

CCTGATGATCTCCCGGACCCCCGAAGTGACCTGCGTGGTGGTGGACGTGT

CCCACGAGGACCCTGAAGTGAAGTTTAATTGGTACGTGGACGGCGTGGAA

GTGCATAACGCCAAGACCAAGCCCAGAGAGGAACAGTACAACTCCACCTA

CCGGGTGGTGTCCGTGCTGACCGTGCTGCACCAGGACTGGCTGAACGGCA

AAGAGTACAAGTGCAAGGTGTCCAACAAGGCCCTGCCTGCCCCCATCGAA

AAGACCATCAGCAAGGCCAAGGGCCAGCCTCGCGAGCCCCAGGTGTACAC

CCTGCCCCCTAGCCGGGAAGAGATGACCAAGAACCAGGTGTCCCTGACCT

GTCTGGTCAAGGGCTTCTACCCCTCCGATATCGCCGTGGAATGGGAGTCC

AACGGCCAGCCCGAGAACAACTACAAGACCACCCCCCCTGTGCTGGACAG

CGACGGCTCATTCTTCCTGTACTCCAAGCTGACCGTGGACAAGTCCCGGT

GGCAGCAGGGCAACGTGTTCTCCTGCTCCGTGATGCACGAGGCCCTGCAC

AACCACTACACCCAGAAGTCCCTGTCCCTGTCTCCCGGCAAGTCTGGCGG

AGGATCCGACATCCAGATGACCCAGAGCCCCCTGAGCCTGCCCGTGACAC

CTGGCGAGCCTGCCAGCATCAGCTGCAGAAGCAGCCAGAGCCTGCTGCAC

AGCAACGGCTACAACTACCTGGACTGGTATCTGCAGAAGCCCGGCCAGTC

CCCCCAGCTGCTGATCTACCTGGGCAGCAACAGAGCCAGCGGCGTGCCCG

ACAGATTCAGCGGCAGCGGCTCCGGCACCGACTTCACCCTGAAGATCAGC

CGGGTCGAAGCCGAGGACGTGGGCGTGTACTACTGCATGCAGGCCCTGCA

GACCCCCTGGACCTTCGGCCAGGGCACCAAGGTGGAAATCAAGCGGACAG

GCGGCGGAGGCTCTGGCGGAGGTGGAAGCGGAGGCGGAGGAAGTGGCGGA

GGCGGCTCTGAGGTGCAGCTGCTGGAATCTGGCGGCGGACTGGTGCAGCC

TGGCGGCAGCCTGAGACTGTCTTGCGCCGCCAGCGGCTTCACCTTCAGCG

GCTACATCATGGCCTGGGTCCGACAGGCCCCTGGCAAGGGCCTGGAATGG

GTGTCCTACATCTACCCCAGCGGCGGCATCACCGTGTACGCCGACAGCGT

GAAGGGCCGGTTCACCATCAGCCGGGACAACAGCAAGAACACCCTGTACC

TGCAGATGAACAGCCTGCGGGCCGAGGACACCGCCGTGTACTATTGCACC

CGGCAGCGGTACGAGGCCCCAAGTACTACTACTACATGGACGTGTGGGG

CAAGGGCACCACCGTGACCGTGTCCAGCTGAATCTAGA
``` pRh1 expression plasmids encoding the above-noted bispecific antibodies were generated. Following 0.2 um sterile filtration, the plasmids were transfected into 60 mL dl cultures of Expi293F™ cells, cultured in Expi293™ expression medium, using ExpiFectamine™ as a transfection reagent, as described by the LifeTech protocol (Life Technologies™, Carlsbad, Calif.). Expifectamine™ transfection enhancers 1 and 2 were added on day 2 of culture as described in LifeTech protocol. Cultures were incubated at 37C, 8% $CO_2$, 140 rpm through day 7. Cultures were harvested by centrifugation followed by 0.2 um sterile filtration and stored at 4° C. Clones were batch purified using a protein A column.

Varying concentrations of the bispecific antibodies were incubated with individual FXIIa and pKal samples, and the ability of these proteases to cleave a peptide substrate was monitored over time by measuring changes in the fluorescence of a chemical moiety covalently attached to the peptide substrate. Slopes of this kinetic data are equivalent to enzymatic proteolytic rates, which are then plotted against the concentration of the inhibitor. The resulting plots are then fit to a tight binding inhibitor equation (Equation 1) by nonlinear regression to obtain apparent inhibition constants ($K_i^{app}$).

$$v = V_0 \cdot \frac{([E] - [I] - K_i^{app}) + \sqrt{([E] - [I] - K_i^{app})^2 - 4[E] \cdot K_i^{app}}}{2} \quad \text{[Equation 1]}$$

Figure 2:
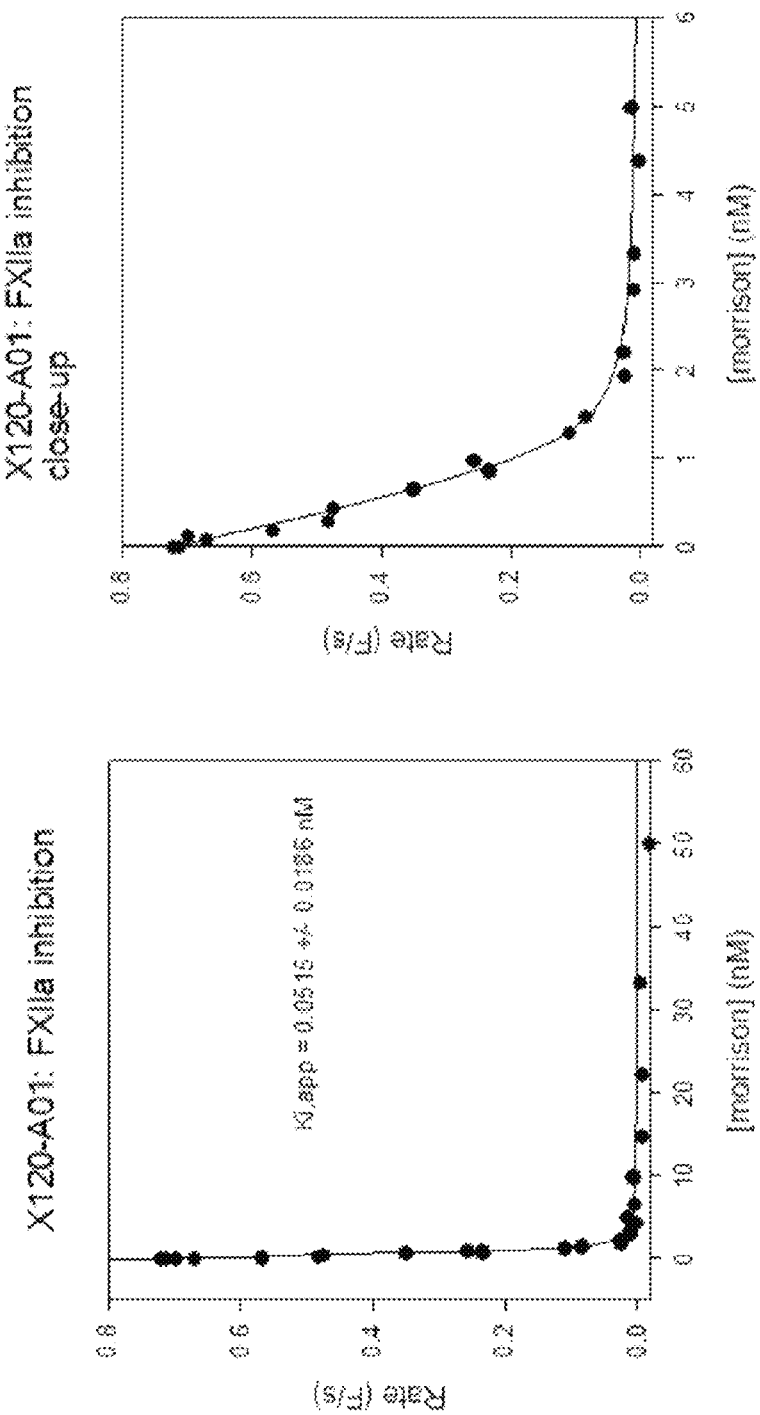
FIG. 2 includes graphs showing the FXIIa inhibition activity of clones X120-A01 (A and B), X122-A01 (C), X121-E01 (D). X122-001 (E), and control clone M71-F06 IgG (F).
Figure 2:
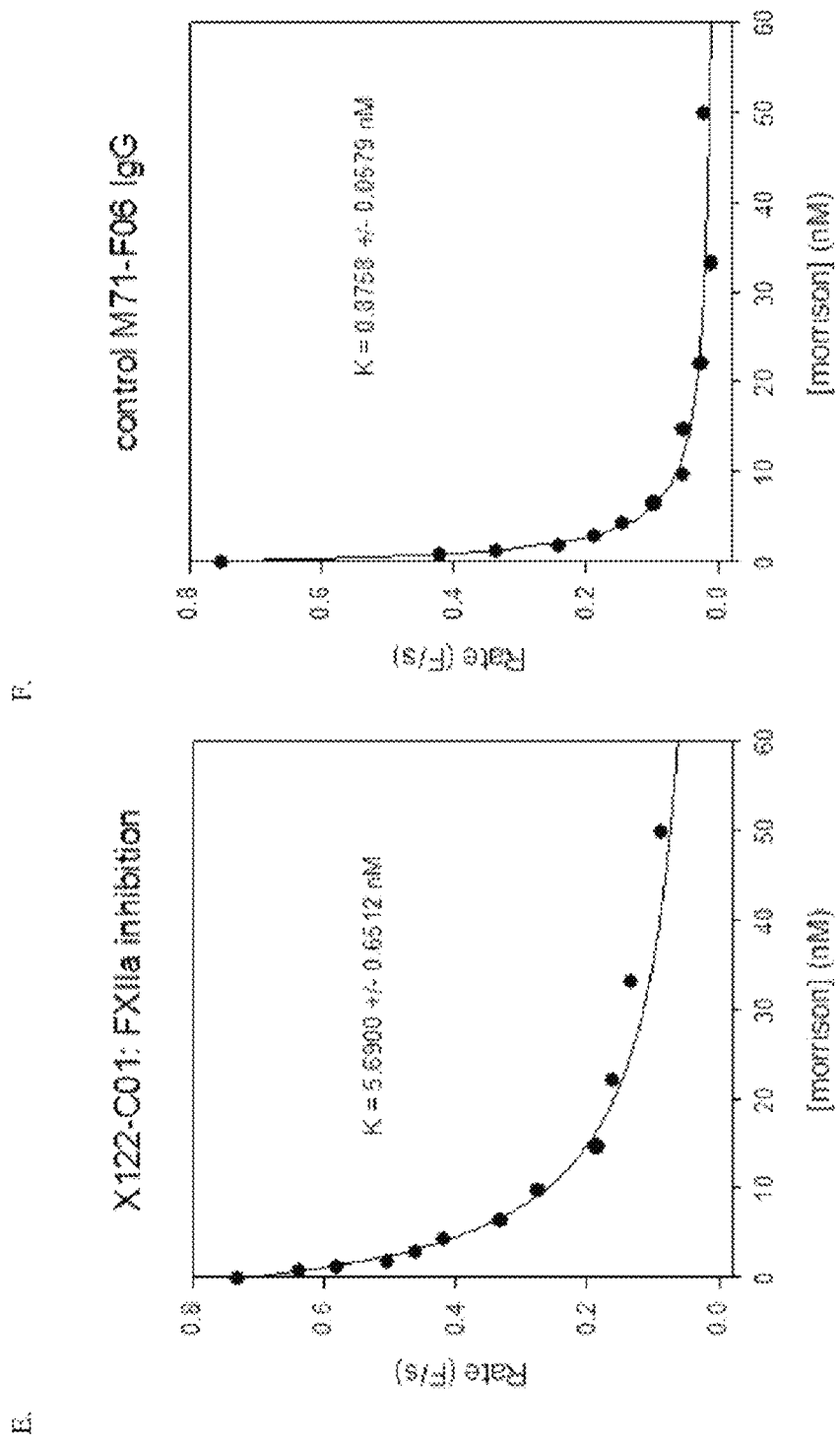

FIGS. 1 and 2 show the plots of pKal and FXIIa inhibition activities for each bispecific antibody tested. All clones tested were able to inhibit both pKal and FXIIa. The $K_i^{app}$ pKal and FXIIa for each bispecific antibody is listed below in Table 3.

TABLE 3

Apparent inhibition constants for bispecific antibodies

| Bispecific antibody | $K_i^{app}$ pKal (nM) | $K_i^{app}$ FXIIa (nM) |
|---|---|---|
| X120-A01 | 0.1376 +/− 0.0206 | 0.0515 +/− 0.0186 |
| X121-E01 | 0.1593 +/− 0.0245 | 0.6114 +/− 0.0714 |

TABLE 3-continued

Apparent inhibition constants for bispecific antibodies

| Bispecific antibody | $K_i^{app}$ pKal (nM) | $K_i^{app}$ FXIIa (nM) |
|---|---|---|
| X122-A01 | 0.1693 +/− 0.0242 | 6.0467 +/− 0.6497 |
| X122-C01 | 0.1610 +/− 0.0221 | 5.6900 +/− 0.6512 |
| Control M71-F06 IgG | N/A | 0.8758 +/− 0.0579 |

Example 2: Construction and Characterization of Exemplary Bispecific Antibodies that Bind pKal and Factor XIIa Another exemplary set of anti-pKal/anti-FXIIa bispecific antibodies was constructed as follows. The IgG portion of the molecule was the same as used in Example 1, i.e., DX-2930. For the anti-FXIIa component, 36 isolates were chosen and were converted to scFvs in both the Light/Heavy and Heavy/Light orientations. The scFvs were fused to the DX-2930 IgG using an SGGGS (SEQ ID NO: 22) linker. When constructing the scFvs, a $(G_4S)_4$ linker was used to fuse the anti-FXIIa variable heavy and variable light domains to each other. The sequences of the bi-specific antibodies are provided below.

The constructed bispecific molecules showed anti-pKal activity generally consistent with values previously determined for DX-2930 (Table 4). Some values showed less potency against pKal, possibly due to errors in calculating concentration, or possibly due to aggregation. The anti-FXIIa activity of the scFv component was typically lower than the previously determined values, possibly due to inherent instability associated with scFvs (Table 4). The activity of the bispecific molecules in the plasma assay showed marked improvement over DX-2930 and the anti-FXIIa IgGs. DX-2930 showed a range between 70-100 nM in this assay, while the anti-FXIIa parent antibody showed inhibition in the ~100 nM range. A panel of the bispecific molecules tested show inhibition in the 1-10 nM range (Table 5).

TABLE 4

Ki, apparent of 72 bispecific anti-pKal + anti-FXIIa antibodies against the respective targets. DX-2930 and a FXIIa lead candidate (559C-M0292-D07) were used as controls.

| | ScFv Orientation | Bispecific Isolate | FXII-name | Anti-pKal Corrected Ki, app (pM) | Anti-FXIIa Corrected Ki, app (pM) |
|---|---|---|---|---|---|
| 1 | H→L | 620I-X136-C07 | 559C-M0177-B11 | 182 | 699 |
| | L→H | 620I-X138-A08 | 559C-M0177-B11 | 920 | 357 |
| 2 | H→L | 620I-X136-B02 | 559C-M0177-C12 | 210 | 2857 |
| | L→H | 620I-X139-A12 | 559C-M0177-C12 | 2053 | 4084 |
| 3 | H→L | 620I-X137-B08 | 559C-M0178-A08 | 312 | 409 |
| | L→H | 620I-X142-A04 | 559C-M0178-A08 | 162 | 1233 |
| 4 | H→L | 620I-X142-B11 | 559C-M0179-A03 | 622 | 7719 |
| | L→H | 620I-X138-B01 | 559C-M0179-A03 | 169 | 6628 |
| 5 | H→L | 620I-X136-C01 | 559C-M0182-B04 | 173 | 957 |
| | L→H | 620I-X138-A12 | 559C-M0182-B04 | 405 | 1925 |
| 6 | H→L | 620I-X136-A12 | 559C-M0182-D04 | 234 | 304 |
| | L→H | 620I-X138-A02 | 559C-M0182-D04 | 206 | 288 |
| 7 | H→L | 620I-X136-A05 | 559C-M0182-H01 | 179 | 111 |
| | L→H | 620I-X138-C07 | 559C-M0182-H01 | 196 | 314 |
| 8 | H→L | 620I-X136-E07 | 559C-M0182-H04 | 190 | 312 |
| | L→H | 620I-X142-B02 | 559C-M0182-H04 | 156 | 955 |
| 9 | H→L | 620I-X136-F11 | 559C-M0183-B12 | 201 | 235 |
| | L→H | 620I-X142-A05 | 559C-M0183-B12 | 160 | 2140 |
| 10 | H→L | 620I-X136-C09 | 559C-M0183-C03 | 173 | 90 |
| | L→H | 620I-X138-B10 | 559C-M0183-C03 | 75 | 58 |
| 11 | H→L | 620I-X136-C08 | 559C-M0183-D08 | 216 | 1231 |
| | L→H | 620I-X139-A11 | 559C-M0183-D08 | 235 | 3835 |

TABLE 4-continued

Ki, apparent of 72 bispecific anti-pKal + anti-FXIIa antibodies against the respective targets. DX-2930 and a FXIIa lead candidate (559C-M0292-D07) were used as controls.

|   | ScFv Orientation | Bispecific Isolate | FXII-name | Anti-pKal Corrected Ki, app (pM) | Anti-FXIIa Corrected Ki, app (pM) |
|---|---|---|---|---|---|
| 12 | H→L | 620I-X136-D05 | 559C-M0183-H08 | 55 | 13 |
|  | L→H | 620I-X138-D04 | 559C-M0183-H08 | 215 | 79 |
| 13 | H→L | 620I-X136-G08 | 559C-M0184-B04 | 176 | 28 |
|  | L→H | 620I-X142-B07 | 559C-M0184-B04 | 224 | 775 |
| 14 | H→L | 620I-X142-A11 | 559C-M0184-D01 | 158 | 195 |
|  | L→H | 620I-X138-G12 | 559C-M0184-D01 | 186 | 766 |
| 15 | H→L | 620I-X142-A10 | 559C-M0184-E06 | 175 | 389 |
|  | L→H | 620I-X138-D03 | 559C-M0184-E06 | 79 | 344 |
| 16 | H→L | 620I-X137-C08 | 559C-M0184-F12 | 153 | 34 |
|  | L→H | 620I-X142-E02 | 559C-M0184-F12 | 162 | 186 |
| 17 | H→L | 620I-X136-E05 | 559C-M0191-A03 | 158 | 172 |
|  | L→H | 620I-X138-B06 | 559C-M0191-A03 | 330 | 405 |
| 18 | H→L | 620I-X136-A09 | 559C-M0191-B11 | 190 | X |
|  | L→H | 620I-X138-A06 | 559C-M0191-B11 | 145 | X |
| 19 | H→L | 620I-X137-A10 | 559C-M0191-C09 | 195 | 205 |
|  | L→H | 620I-X139-B10 | 559C-M0191-C09 | 247 | 189 |
| 20 | H→L | 620I-X136-A04 | 559C-M0191-E04 | 171 | 230 |
|  | L→H | 620I-X138-D06 | 559C-M0191-E04 | 199 | 132 |
| 21 | H→L | 620I-X136-C11 | 559C-M0191-E09 | 154 | 38 |
|  | L→H | 620I-X138-B07 | 559C-M0191-E09 | 246 | 135 |
| 22 | H→L | 620I-X136-A02 | 559C-M0191-H09 | 176 | 136 |
|  | L→H | 620I-X139-G02 | 559C-M0191-H09 | 171 | 161 |
| 23 | H→L | 620I-X136-B07 | 559C-M0191-H10 | 168 | 99 |
|  | L→H | 620I-X138-E03 | 559C-M0191-H10 | 178 | 122 |
| 24 | H→L | 620I-X136-G05 | 559C-M0192-A01 | 179 | 100 |
|  | L→H | 620I-X139-D12 | 559C-M0192-A01 | 428 | 383 |
| 25 | H→L | 620I-X136-A01 | 559C-M0192-A03 | 135 | 224 |
|  | L→H | 620I-X138-C12 | 559C-M0192-A03 | 267 | 697 |
| 26 | H→L | 620I-X136-G10 | 559C-M0192-D02 | 171 | 28 |
|  | L→H | 620I-X138-D05 | 559C-M0192-D02 | 519 | 139 |
| 27 | H→L | 620I-X136-F07 | 559C-M0192-D12 | 183 | 167 |
|  | L→H | 620I-X138-A01 | 559C-M0192-D12 | 154 | 465 |
| 28 | H→L | 620I-X142-E09 | 559C-M0192-F01 | 174 | 163 |
|  | L→H | 620I-X138-D11 | 559C-M0192-F01 | 178 | 443 |
| 29 | H→L | 620I-X136-C05 | 559C-M0192-F06 | 150 | 58 |
|  | L→H | 620I-X142-A02 | 559C-M0192-F06 | 152 | 63 |

TABLE 4-continued

Ki, apparent of 72 bispecific anti-pKal + anti-FXIIa antibodies against the respective targets. DX-2930 and a FXIIa lead candidate (559C-M0292-D07) were used as controls.

| | ScFv Orientation | Bispecific Isolate | FXII-name | Anti-pKal Corrected Ki, app (pM) | Anti-FXIIa Corrected Ki, app (pM) |
|---|---|---|---|---|---|
| 30 | H→L | 620I-X136-C04 | 559C-M0192-F07 | 205 | 189 |
| | L→H | 620I-X138-F02 | 559C-M0192-F07 | 464 | 794 |
| 31 | H→L | 620I-X136-G04 | 559C-M0192-G03 | 179 | 107 |
| | L→H | 620I-X139-G12 | 559C-M0192-G03 | 276 | 252 |
| 32 | H→L | 620I-X136-B11 | 559C-M0192-G05 | 172 | 184 |
| | L→H | 620I-X142-D04 | 559C-M0192-G05 | 170 | 414 |
| 33 | H→L | 620I-X136-D06 | 559C-M0192-H04 | 176 | 84 |
| | L→H | 620I-X139-A01 | 559C-M0192-H04 | 146 | 53 |
| 34 | H→L | 620I-X136-D12 | 559C-M0192-H11 | 179 | 63 |
| | L→H | 620I-X138-F05 | 559C-M0192-H11 | 214 | 147 |
| 35 | H→L | 620I-X136-A11 | 559C-M0292-D07 | 199 | 193 |
| | L→H | 620I-X139-E05 | 559C-M0292-D07 | 196 | 172 |
| 36 | H→L | 620I-X136-C12 | 559C-M0177-A06 | 217 | 1567 |
| | L→H | 620I-X138-E05 | 559C-M0177-A06 | 186 | 245 |
| 37 | Plate 1 | | DX-2930 | 160 | X |
| | Plate 2 | | DX-2930 | 138 | X |
| 38 | Plate 1 | | 559C-M292-D07 | X | 36 |
| | Plate 2 | | 559C-M292-D07 | X | 38 |

TABLE 5

Comparison of parental anti-FXIIa isolates and anti-pKal/anti-FXIIa bispecific molecules in plasma activation assay. Plasma was diluted 1:40. Inhibitors added to dilute plasma. 2.5% Ellagic Acid added to plasma. After 2 minutes, activation was quenched by addition of Corn Trypsin Inhibitor. pKal activity was measured by the addition of a profluorescent substrate.

| | | Plasma Inhibition | |
|---|---|---|---|
| FXII IgG isolate name | Bispecific Iso name | IgG IC50 (nM) | bispecific IC50/Ki (nM) |
| 559C-M0192-A03 | 620I-X0136-A01 | 514 | 52 |
| 559C-M0192-F06 | 620I-X0136-C05 | 304 | 2.6 |
| 559C-M0191-E09 | 620I-X0136-C11 | 31 | 1.8 |
| 559C-M0192-H11 | 620I-X0136-D12 | 101 | 3 |
| 559C-M0192-A01 | 620I-X0136-G05 | 198 | 8 |

Five exemplary candidates (620I-X0136-D12, 620I-X0136-C05, 620I-X0136-C11, 620I-X0136-G05, and 620I-X0136-A01) were selected for further analysis. Of these 5 lead candidates, 620I-X0136-A01 was eliminated due to low expression values and multiple species in the size exclusion chromatography (SEC) traces. Of the remaining 4 lead candidates, each isolate contained a varying degree of High Molecular Weight aggregate (16-35%) (FIG. 3). This aggregate was determined to be concentration-dependent and was hypothesized to be dimeric structures interacting through the scFv domains.

Figure 5:
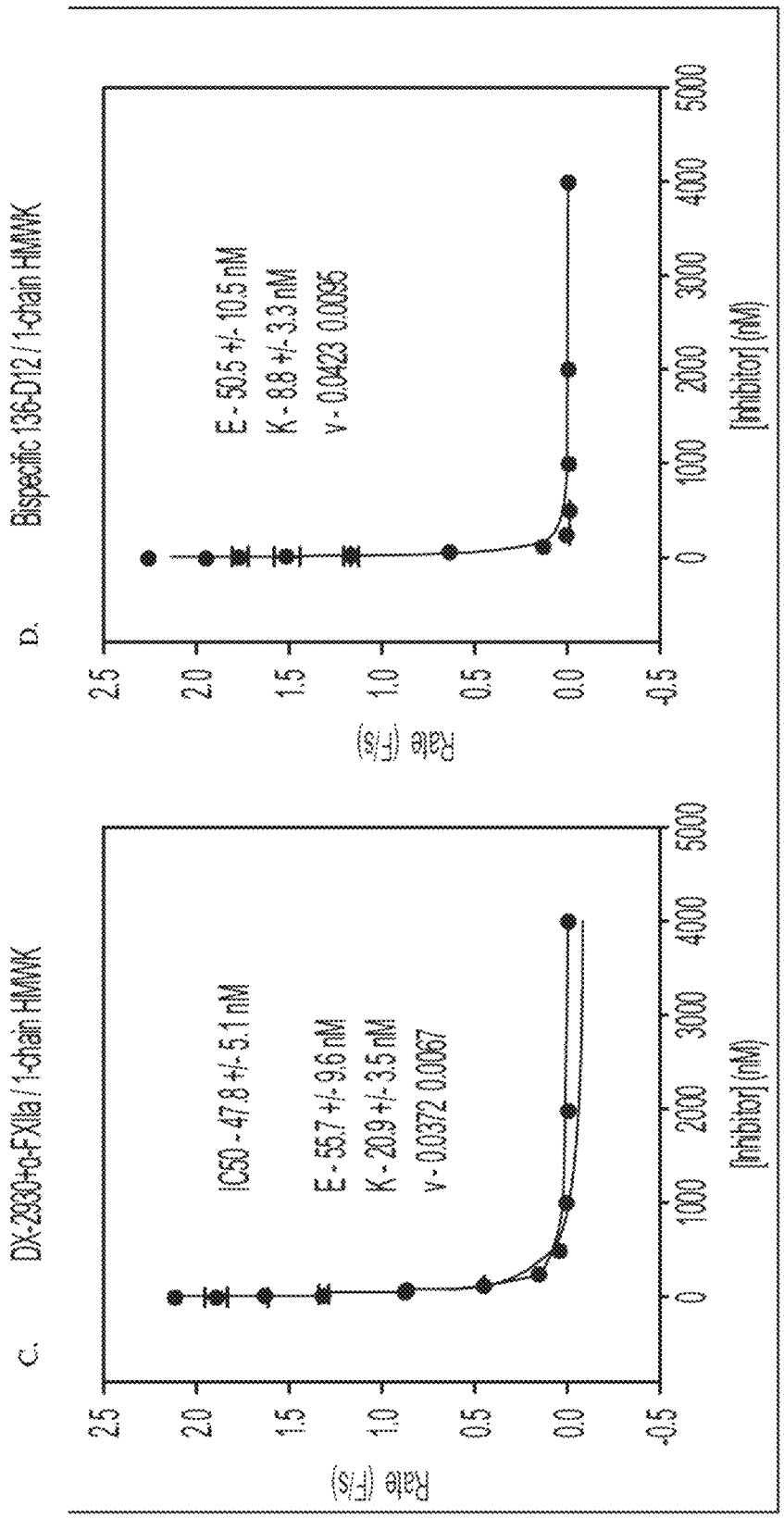
FIG. 5 includes graphs showing the inhibitory activities of an anti-pKal antibody, an anti-FXIIa antibody, a combination of the anti-pKal antibody and the anti-FXIIa antibody, and the bispecific antibody D12, as determined by a reconstituted plasma assay. A: DX-2930 in the presence of one-chain HMWK. B: anti-FXIIa antibody in the presence of one-chain HMWK. C: DX-2930+anti-FXIIa in the presence of one-chain HMWK. D: bispecific clone 620I-X0136-D12 in the presence of one-chain HMWK.
Figure 6:
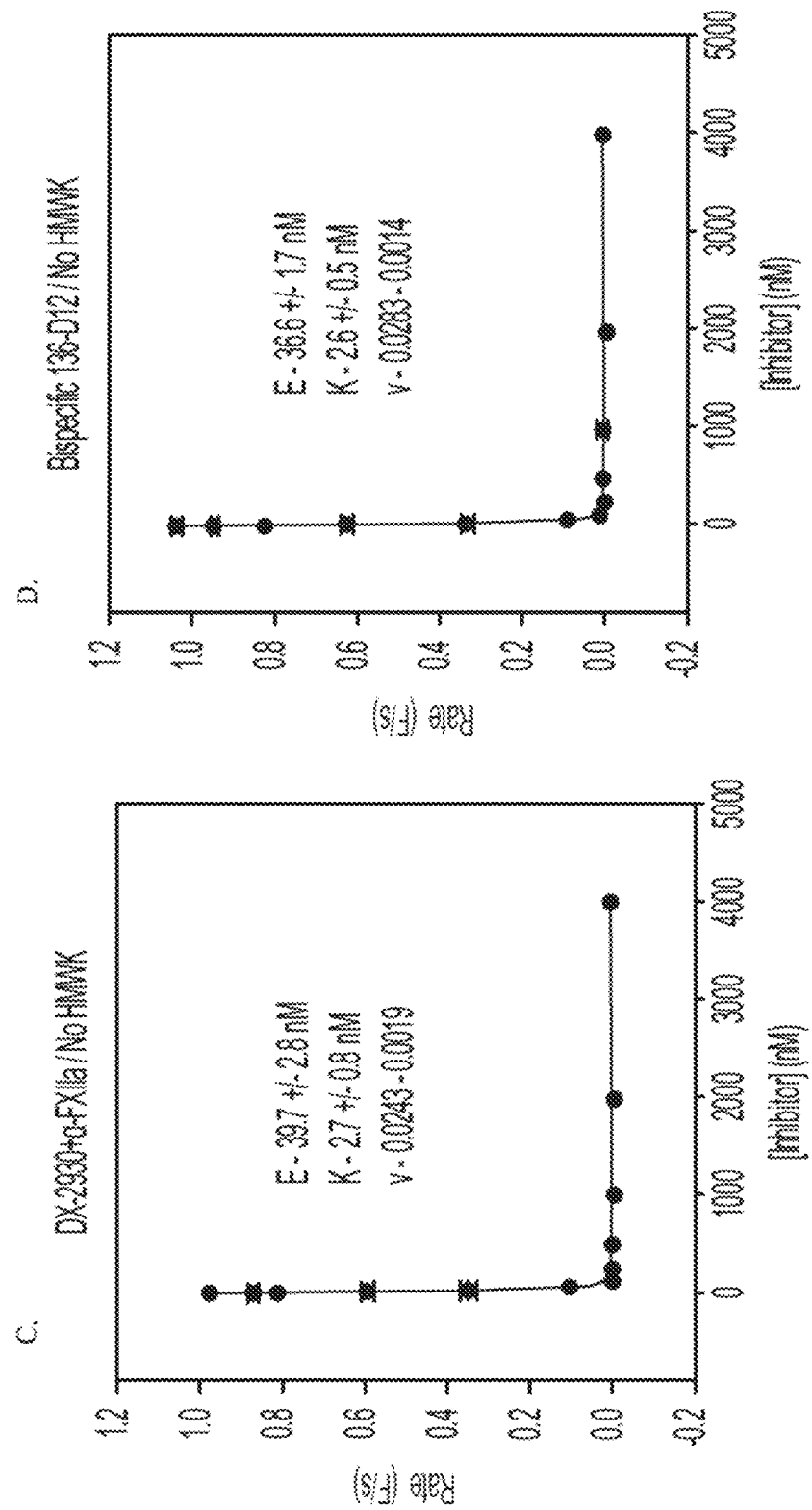
FIG. 6 includes graphs showing the inhibitory activities of an anti-pKal antibody, an anti-FXIIa antibody, a combination of the anti-pKal antibody and the anti-FXIIa antibody, and the bispecific antibody D12, as determined by a reconstituted plasma assay. A: DX-2930 in the absence of HMWK. B: anti-FXIIa antibody in the absence of HMWK. C: DX-2930+anti-FXIIa in the absence of HMWK. D: bispecific clone 620I-X0136-D12 in the absence of HMWK.

An exemplary bispecific antibody, 620I-X0136-D12 (D12) was assessed for its ability to inhibit plasma pKal activity by the plasma inhibition assay. Briefly, reconstituted plasma containing quantities of pre-pKal and FXII in the presence or absence of HMWK was diluted 1:40 in an assay buffer (20 mM Tris-HCl pH 7.5, 150 mM NaCl, 1 mM EDTA, 0.1% PEG-8000 and 0.1% Triton X-100). The concentrations of pre-pKal, FXII, and HMWK are equivalent to their normal concentrations in plasma. Inhibitors were added to the reconstituted plasma at varying concentrations in a 96-well microplate at room temperature. Contact activation was then initiated by the addition of 25% (2.5% final) of a dilute ellagic acid solution, the microplate was mixed by gentle shaking, and allowed to proceed for 2 minutes at room temperature, whereby 100 nM of CTI was added. 10 μl of this mixture was then removed to a replicate microplate containing 80 μl of assay buffer at pre-equilibrated at 30 C. This dilution plate was then incubated a further 5 minutes at 30C, and proteolysis of PFR-AMC assessed as above, but with back-calculated concentrations of inhibitor used in the X-axis for curve-fitting to a modified Morrison equation for tight binding inhibitors (plasma was diluted 1:400 in final assay read). The results of this study are shown in FIG. 5 (in the presence of one-chain HMWK) and FIG. 6 (in the absence of HMWK). The bispecific antibody performed better than the sum of the parent IgGs, particularly in the presence of HMWK. Using the tight binding inhibitor equation, the apparent Ki values of D12 were determined to be 8.8 nM in the presence of HMWK and 2.6 nM in the absence of HMWK.

Figure 7:
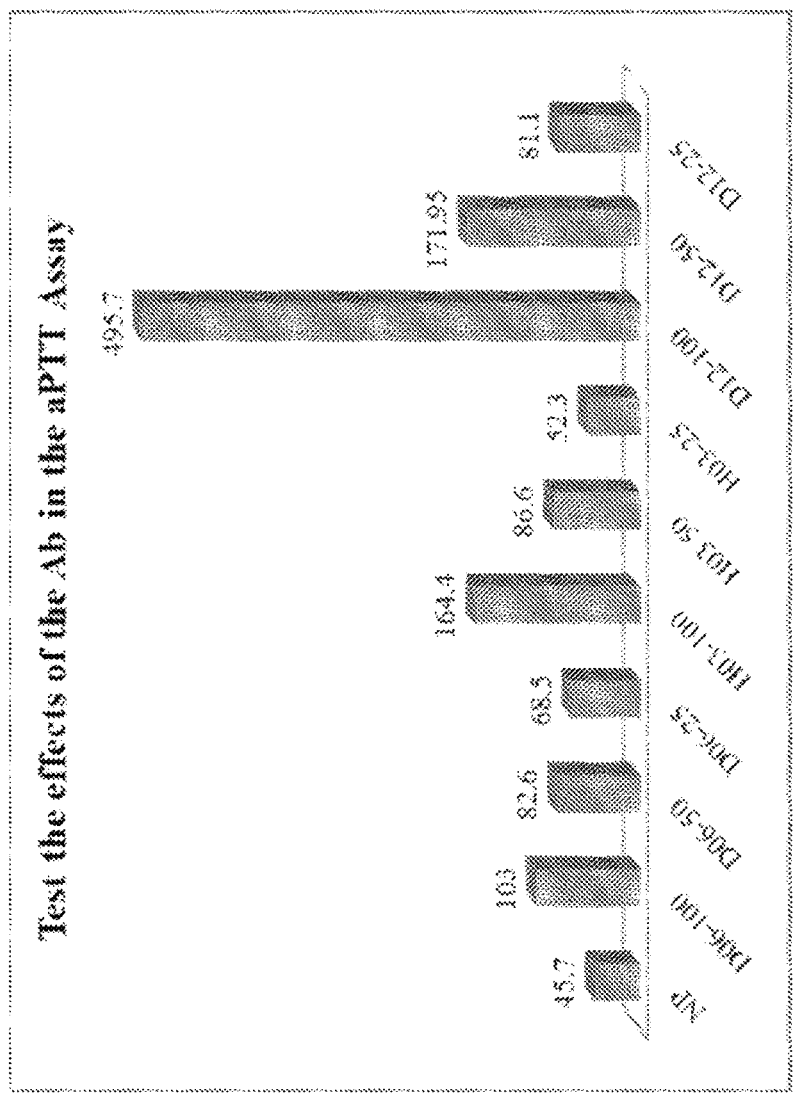
FIG. 7 includes graphs showing the inhibitory activities of an anti-pKal antibody, an anti-FXIIa antibody, a combination of the anti-pKal antibody and the anti-FXIIa antibody, and the bispecific antibody D12, as determined by a plasma assay. A: DX-2930 in the absence of HMWK. B: anti-FXIIa antibody in the absence of HMWK. C: DX-2930+anti-FXIIa in the absence of HMWK. D: bispecific clone D12 in the absence of HMWK.

The bispecific antibody candidate 620I-X0136-D12 (D12) was also assessed for its ability to delay activated partial thromboplastin time (APTT) in an APTT assay compared to an anti-FXIIa antibody (D06) and an anti-pKal antibody (H03) (FIG. 7). Briefly, inhibitors molecules (or control dilution buffer=25 mM HEPES, pH 7.5, 125 mM NaCl) were added at three concentrations (25, 50, 100) to neat plasma in a 1:1 mixture, and pre-equilibrated at 37° C. for 5 minutes. 2×50 μl of this mix was dispensed to 2 separate KC4 Delta assay cuvettes (with metal ball). After 60 seconds, 50 μl of aPTT reagent (activator, Pacific Hemostasis APTT-XL) was added to the rotating cuvettes, and 180 seconds after aPTT addition (at t=0 secs), 50 μl of CaCl2 was added. The KC4 Delta instrument recorded the time of coagulation in seconds.

Figure 8:
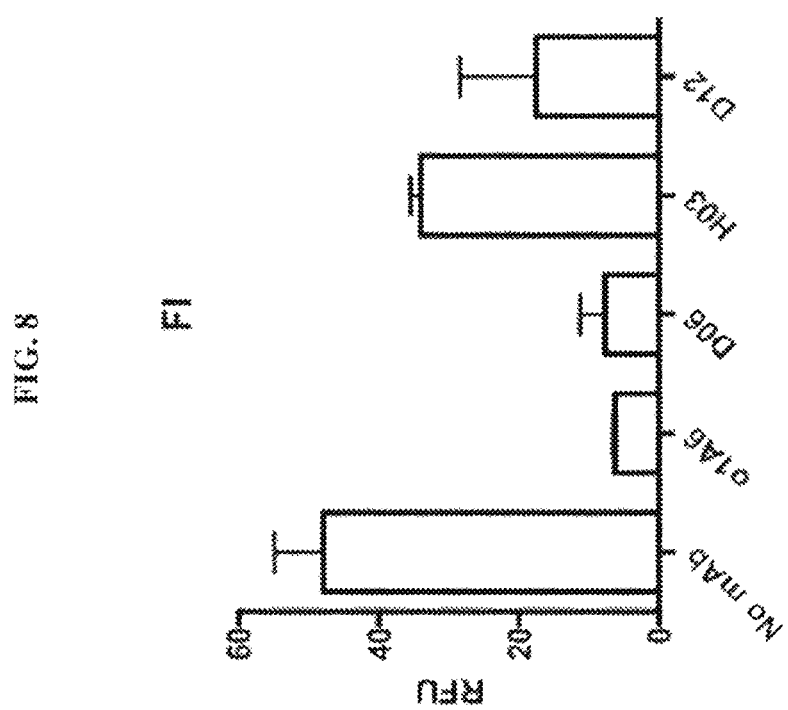
FIG. 8 is a graph showing the effects of a bispecific antibody (D12) at three concentrations compared to an anti-FXIIa antibody (D06) and an anti-pKal antibody (H03) in an activated partial thromboplastin time (APTT) assay.

The bispecific antibody candidate 620I-X0136-D12 (D12) was also assessed for its ability to inhibit fibrin formation (FIG. 8).

Antibody sequences: All bispecific molecules described in this Example contained a first polypeptide comprising the DX-2930 Heavy Chain, a SGGGS linker, and an anti-FXIIa scFv in either the Heavy/Light or Light/Heavy orientations. The DX-2930 Light Chain was also expressed using the same vector. Only the Heavy Chain+scFv sequences are listed for each isolate.

```
>DX-2930 Light Chain (without signal sequence)
                                      (SEQ ID NO: 46)
DIQMTQSPSTLSASVGDRVTITCRASQSISSWLAWYQQKPGKAPKLLIYK

ASTLESGVPSRFSGSGSGTEFTLTISSLQPDDFATYYCQQYNTYWTFGQG

TKVEIKRTVAAPSVFIFPPSDEQLKSGTASVVCLLNNFYPREAKVQWKVD

NALQSGNSQESVTEQDSKDSTYSLSSTLTLSKADYEKHKVYACEVTHQGL

SSPVTKSFNRGEC

Bispecifics derived from 36 exemplary anti-FXIIa
IgGs:

>620I-X0136-C07 = DX2930 Heavy Chain +
559C-M0177-B11 L4H scFv
                                      (SEQ ID NO: 51)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSRYIMVWVRQAPGK

GLEWVSRIYPSGGYTRYADSVKGRFTISRDNSKNTLYLQMNSLRAEDTAV

YYCTRQRYRGPKYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-A08 = DX2930 Heavy Chain +
559C-M0177-B11 H4L scFv
                                      (SEQ ID NO: 52)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSRYIMVWVRQAPGKGLEWVSRIYPSGGYTR

YADSVKGRFTISRDNSKNTLYLQMNSLRAEDTAVYYCTRQRYRGPKYYYY

MDVWGKGTTVTVSS

>620I-X0136-B02 = DX2930 Heavy Chain +
559C-M0177-C12 L4H scFv
                                      (SEQ ID NO: 53)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSYHMHWVRQAPGK

GLEWVSRIVPSGGMTRYADSVKGRFTISRDNSKNTLYLQMNSLRAEDTAV
```

-continued
YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0139-A12 = DX2930 Heavy Chain +
559C-M0177-C12 H4L scFv
(SEQ ID NO: 54)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSYHMHWVRQAPGKGLEWVSRIVPSGGMTR

YADSVKGRFTISRDNSKNTLYLQMNSLRAEDTAVYYCTRQRYRGPKYYYY

MDVWGKGTTVTVSS

>620I-X0137-B08 = DX2930 Heavy Chain +
559C-M0178-A08 L4H scFv
(SEQ ID NO: 55)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSYIMGWVRQAPGK

GLEWVSRIYPSGGATQYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0142-A04 = DX2930 Heavy Chain +
559C-M0178-A08 H4L scFv
(SEQ ID NO: 56)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

-continued
IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSYIMGWVRQAPGKGLEWVSRIYPSGGATQ

YADSVKGRFTISRDNSKNTLYLQMNSLRAEDTAVYYCTRQRYRGPKYYYY

MDVWGKGTTVTVSS

>620I-X0142-B11 = DX2930 Heavy Chain +
559C-M0179-A03 L4H scFv
(SEQ ID NO: 57)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSGYIMAWVRQAPGK

GLEWVSYIYPSGGITVYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDIGVYYCMQGRHRP

YTFGQGTRLEIKR

>620I-X0138-B01 = DX2930 Heavy Chain +
559C-M0179-A03 H4L scFv
(SEQ ID NO: 58)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

-continued

KPGQSPQLLIYLGSNRASGVPDRFSGSGSGTDFTLKISRVEAEDIGVYYC

MQGRHRPYTFGQGTRLEIKRTGGGGSGGGGSGGGGSGGGGSEVQLLESGG

GLVQPGGSLRLSCAASGFTFSGYIMAWVRQAPGKGLEWVSYIYPSGGITV

YADSVKGRFTISRDNSKNTLYLQMNSLRAEDTAVYYCTRQRYRGPKYYYY

MDVWGKGTTVTSS

>620I-X0136-C01 = DX2930 Heavy Chain +
559C-M0182-B04 L4H scFv (SEQ ID NO: 59)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYVMQWVRQAPGK

GLEWVSYIYPSGGHTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-A12 = DX2930 Heavy Chain +
559C-M0182-B04 H4L scFv (SEQ ID NO: 60)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSWYVMQWVRQAPGKGLEWVSYIYPSGGHTK

YADSVKGRFTISRDNSKNTLYLQMNSLRAEDTAVYYCTRQRYRGPKYYYY

MDVWGKGTTVTVSS

>620I-X0136-A12 = DX2930 Heavy Chain +
559C-M0182-D04 L4H scFv (SEQ ID NO: 61)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSMYTMNWVRQAPGK

GLEWVSRIYPSGGKTLYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-A02 = DX2930 Heavy Chain +
559C-M0182-D04 H4L scFv (SEQ ID NO: 62)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSMYTMNWVRQAPGKGLEWVSRIYPSGGKTL

YADSVKGRFTISRDNSKNTLYLQMNSLRAEDTAVYYCTRQRYRGPKYYYY

MDVWGKGTTVTVSS

>620I-X0136-A05 = DX2930 Heavy Chain +
559C-M0182-H01 L4H scFv (SEQ ID NO: 63)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSRYVMHWVRQAPGK
GLEWVSSIWPSGGMTKYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR

>620I-X0138-C07 = DX2930 Heavy Chain +
559C-M0182-H01 H4L scFv
(SEQ ID NO: 64)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSRYVMHWVRQAPGKGLEWVSSIWPSGGMTK
YADSVKGRFTISRDNSKNTLYLQMNSLRAEDTAVYYCTRQRYRGPKYYYY
MDVWGKGTTVTVSS >620I-X0136-E07 = DX2930 Heavy Chain +
559C-M0182-H04 L4H scFv
(SEQ ID NO: 65)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYIMGWVRQAPGK
GLEWVSRIYPSGGTTFYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0142-B02 = DX2930 Heavy Chain +
559C-M0182-H04 H4L scFv
(SEQ ID NO: 66)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYIMGWVRQAPGKGLEWVSRIYPSGGTTF
YADSVKGRFTISRDNSKNTLYLQMNSLRAEDTAVYYCTRQRYRGPKYYYY
MDVWGKGTTVTVSS >620I-X0136-F11 = DX2930 Heavy Chain +
559C-M0183-B12 L4H scFv
(SEQ ID NO: 67)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYVMYWVRQAPGK
GLEWVSRIYPSGGITHYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0142-A05 = DX2930 Heavy Chain +
559C-M0183-B12 H4L scFv
(SEQ ID NO: 68)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYVMYWVRQAPGKGLEWVSRIYPSGGITH
YADSVKGRFTISRDNSKNTLYLQMNSLRAEDTAVYYCTRQRYRGPKYYYY
MDVWGKGTTVTVSS >620I-X0136-C09 = DX2930 Heavy Chain +
559C-M0183-C03 L4H scFv
(SEQ ID NO: 69)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYNMHWVRQAPGK
GLEWVSYISPSGGKTKYTDSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-B10 = DX2930 Heavy Chain +
559C-M0183-C03 H4L scFv
(SEQ ID NO: 70)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYNMHWVRQAPGKGLEWVSYISPSGGKTK
YTDSVKGRFTISRDNSKNTLYLQMNSLRAEDTAVYYCTRQRYRGPKYYYY
MDVWGKGTTVTVSS >620I-X0136-C08 = DX2930 Heavy Chain +
559C-M0183-D08 L4H scFv
(SEQ ID NO: 71)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSRYIMGWVRQAPGK
GLEWVSSIYPSGGVTRYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0139-A11 = DX2930 Heavy Chain +
559C-M0183-D08 H4L scFv
(SEQ ID NO: 72)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSRYIMGWVRQAPGKGLEWVSSIYPSGGVTR
YADSVKGRFTISRDNSKNTLYLQMNSLRAEDTAVYYCTRQRYRGPKYYYY
MDVWGKGTTVTVSS >620I-X0136-D05 = DX2930 Heavy Chain +
559C-M0183-H08 L4H scFv
(SEQ ID NO: 73)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL -continued

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSRYIMHWVRQAPGK

GLEWVSSIYPSGGVTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-D04 = DX2930 Heavy Chain +
559C-M0183-H08 H4L scFv
(SEQ ID NO: 74)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSRYIMHWVRQAPGKGLEWVSSIYPSGGVTK

YADSVKGRFTISRDNSKNTLYLQMNSLRAEDTAVYYCTRQRYRGPKYYYY

MDVWGKGTTVTVSS

>620I-X0136-G08 = DX2930 Heavy Chain +
559C-M0184-B04 L4H scFv
(SEQ ID NO: 75)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSFYSMHWVRQAPGK

GLEWVSRIYPSGGVTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0142-B07 = DX2930 Heavy Chain +
559C-M0184-B04 H4L scFv
(SEQ ID NO: 76)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSFYSMHWVRQAPGKGLEWVSRIYPSGGVTK

YADSVKGRFTISRDNSKNTLYLQMNSLRAEDTAVYYCTRQRYRGPKYYYY

MDVWGKGTTVTVSS

>620I-X0142-A11 = DX2930 Heavy Chain +
559C-M0184-D01 L4H scFv
(SEQ ID NO: 77)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSFYVMGWVRQAPGK

GLEWVSRIYPSGGLTQYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-G12 = DX2930 Heavy Chain +
559C-M0184-D01 H4L scFv (SEQ ID NO: 78)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSFYVMGWVRQAPGKGLEWVSRIYPSGGLTQ
YADSVKGRFTISRDNSKNTLYLQMNSLRAEDTAVYYCTRQRYRGPKYYYY
MDVWGKGTTVTVSS >620I-X0142-A10 = DX2930 Heavy Chain +
559C-M0184-E06 L4H scFv (SEQ ID NO: 79)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYVMQWVRQAPGK
GLEWVSSIWPSGGKTVYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-D03 = DX2930 Heavy Chain +
559C-M0184-E06 H4L scFv (SEQ ID NO: 80)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYVMQWVRQAPGKGLEWVSSIWPSGGKTV
YADSVKGRFTISRDNSKNTLYLQMNSLRAEDTAVYYCTRQRYRGPKYYYY
MDVWGKGTTVTVSS >620I-X0137-C08 = DX2930 Heavy Chain +
559C-M0184-F12 L4H scFv (SEQ ID NO: 81)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYVMHWVRQAPGK
GLEWVSGIWPSGGRTKYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0142-E02 = DX2930 Heavy Chain +
559C-M0184-F12 H4L scFv (SEQ ID NO: 82)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYVMHWVRQAPGKGLEWVSGIWPSGGRTK

```
YADSVKGRFTISRDNSKNTLYLQMNSLRAEDTAVYYCTRQRYRGPKYYYY
MDVWGKGTTVTVSS

>620I-X0136-E05 = DX2930 Heavy Chain +
559C-M0191-A03 L4H scFv
                                    (SEQ ID NO: 83)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSQYIMHWVRQAPGK
GLEWVSSIYPSGGNTKYADSVKGRFTISRDNSKNTLYLQMNSLRAEDTAV
YYCTRQRYRGPKYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-B06 = DX2930 Heavy Chain +
559C-M0191-A03 H4L scFv
                                    (SEQ ID NO: 84)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSQYIMHWVRQAPGKGLEWVSSIYPSGGNTK
YADSVKGRFTISRDNSKNTLYLQMNSLRAEDTAVYYCTRQRYRGPKYYYY
MDVWGKGTTVTVSS >620I-X0136-A09 = DX2930 Heavy Chain +
559C-M0191-B11 H4L scFv
                                    (SEQ ID NO: 85)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFS >620I-X0138-A06 = DX2930 Heavy Chain +
559C-M0191-B11 H4L scFv
                                    (SEQ ID NO: 86)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFS >620I-X0137-A10 = DX2930 Heavy Chain +
559C-M0191-C09 L4H scFv
                                    (SEQ ID NO: 87)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSPYIMHWVRQAPGK
GLEWVSRIYPSGGATVYADSVKGRFTISRDNSKNTLYLQMNSLRAEDTAV
YYCTRQRYRGPKYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0139-B10 = DX2930 Heavy Chain +
559C-M0191-C09 H4L scFv
                                    (SEQ ID NO: 88)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
```

IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSPYIMHWVRQAPGKGLEWVSRIYPSGGATV
YADSVKGRFTISRDNSKNTLYLQMNSLRAEDTAVYYCTRQRYRGPKYYYY
MDVWGKGTTVTVSS

>620I-X0136-A04 = DX2930 Heavy Chain +
559C-M0191-E04 L4H scFv (SEQ ID NO: 89)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSMYIMHWVRQAPGK
GLEWVSSIYPSGGMTKYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-D06 = DX2930 Heavy Chain +
559C-M0191-E04 H4L scFv (SEQ ID NO: 90)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSMYIMHWVRQAPGKGLEWVSSIYPSGGMTK
YADSVKGRFTISRDNSKNTLYLQMNSLRAEDTAVYYCTRQRYRGPKYYYY
MDVWGKGTTVTVSS >620I-X0136-C11 = DX2930 Heavy Chain +
559C-M0191-E09 L4H scFv (SEQ ID NO: 91)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYSMHWVRQAPGK
GLEWVSVIYPSGGKTRYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-B07 = DX2930 Heavy Chain +
559C-M0191-E09 H4L scFv (SEQ ID NO: 92)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYSMHWVRQAPGKGLEWVSIYPSGGKTR
YADSVKGRFTISRDNSKNTLYLQMNSLRAEDTAVYYCTRQRYRGPKYYYY
MDVWGKGTTVTVSS >620I-X0136-A02 = DX2930 Heavy Chain +
559C-M0191-H09 L4H scFv
(SEQ ID NO: 93)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSMYVMHWVRQAPGK
GLEWVSSIYPSGGLTKYADSVKGRFTISRDNSKNTLYLQMNSLRAEDTAV
YYCTRQRYRGPKYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0139-G02 = DX2930 Heavy Chain +
559C-M0191-H09 H4L scFv
(SEQ ID NO: 94)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSMYVMHWVRQAPGKGLEWVSSIYPSGGLTK
YADSVKGRFTISRDNSKNTLYLQMNSLRAEDTAVYYCTRQRYRGPKYYYY
MDVWGKGTTVTVSS >620I-X0136-B07 = DX2930 Heavy Chain +
559C-M0191-H10 L4H scFv
(SEQ ID NO: 95)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSWYTMHWVRQAPGK
GLEWVSSIYPSGGFTRYADSVKGRFTISRDNSKNTLYLQMNSLRAEDTAV
YYCTRQRYRGPKYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-E03 = DX2930 Heavy Chain +
559C-M0191-H10 H4L scFv
(SEQ ID NO: 96)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYTMHWVRQAPGKGLEWVSSIYPSGGFTR
YADSVKGRFTISRDNSKNTLYLQMNSLRAEDTAVYYCTRQRYRGPKYYYY
MDVWGKGTTVTVSS >620I-X0136-G05 = DX2930 Heavy Chain +
559C-M0192-A01 L4H scFv
(SEQ ID NO: 97)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSHYVMHWVRQAPGK
GLEWVSSIYPSGGLTKYADSVKGRFTISRDNSKNTLYLQMNSLRAEDTAV
YYCTRQRYRGPKYYYMDVWGKGTTVTVSSGGGGSGGGGSGGGGSGGGGS
DIQMTQSPLSLPVTPGEPASISCRSSQSLLHSNGYNYLDWYLQKPGQSPQ -continued
LLIYLGSNRASGVPDRFSGSGSGTDFTLKISRVEAEDVGVYYCMQALQTP

WTFGQGTKVEIKR

>620I-X0139-D12 = DX2930 Heavy Chain +
559C-M0192-A01 H4L scFv
(SEQ ID NO: 98)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSHYVMHWVRQAPGKGLEWVSSIYPSGGLTK

YADSVKGRFTISRDNSKNTLYLQMNSLRAEDTAVYYCTRQRYRGPKYYYY

MDVWGKGTTVTVSS

>620I-X0136-A01 = DX2930 Heavy Chain +
559C-M0192-A03 L4H scFv
(SEQ ID NO: 99)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYVMQWVRQAPGK

GLEWVSSIYPSGGMTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-C12 = DX2930 Heavy Chain +
559C-M0192-A03 H4L scFv
(SEQ ID NO: 100)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSWYVMQWVRQAPGKGLEWVSSIYPSGGMTK

YADSVKGRFTISRDNSKNTLYLQMNSLRAEDTAVYYCTRQRYRGPKYYYY

MDVWGKGTTVTVSS

>620I-X0136-G10 = DX2930 Heavy Chain +
559C-M0192-D02 L4H scFv
(SEQ ID NO: 101)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSQYVMHWVRQAPGK

GLEWVSSIWPSGGFTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-D05 = DX2930 Heavy Chain +
559C-M0192-D02 H4L scFv
(SEQ ID NO: 102)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSQYVMHWVRQAPGKGLEWVSSIWPSGGFTK

YADSVKGRFTISRDNSKNTLYLQMNSLRAEDTAVYYCTRQRYRGPKYYYY

MDVWGKGTTVTVSS

>620I-X0136-F07 = DX2930 Heavy Chain +
559C-M0192-D12 L4H scFv
(SEQ ID NO: 103)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYIMQWVRQAPGK

GLEWVSSIYPSGGRTKYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-A01 = DX2930 Heavy Chain +
559C-M0192-D12 H4L scFv
(SEQ ID NO: 104)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSWYIMQWVRQAPGKGLEWVSSIYPSGGRTK

YADSVKGRFTISRDNSKNTLYLQMNSLRAEDTAVYYCTRQRYRGPKYYYY

MDVWGKGTTVTVSS

>620I-X0142-E09 = DX2930 Heavy Chain +
559C-M0192-F01 L4H scFv
(SEQ ID NO: 105)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYNMAWVRQAPGK

GLEWVSRIYPSGGMTQYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0138-D11 = DX2930 Heavy Chain +
559C-M0192-F01 H4L scFv
(SEQ ID NO: 106)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSWYNMAWVRQAPGKGLEWVSRIYPSGGMTQ

YADSVKGRFTISRDNSKNTLYLQMNSLRAEDTAVYYCTRQRYRGPKYYYY

MDVWGKGTTVTVSS

>620I-X0136-C05 = DX2930 Heavy Chain +
559C-M0192-F06 L4H scFv
(SEQ ID NO: 107)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYVMHWVRQAPGK

-continued
```
GLEWVSSIYPSGGKTSYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR
```

>620I-X0142-A02 = DX2930 Heavy Chain +
559C-M0192-F06 H4L scFv (SEQ ID NO: 108)
```
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSWYVMHWVRQAPGKGLEWVSSIYPSGGKTS
YADSVKGRFTISRDNSKNTLYLQMNSLRAEDTAVYYCTRQRYRGPKYYYY
MDVWGKGTTVTVSS
```

>620I-X0136-C04 = DX2930 Heavy Chain +
559C-M0192-F07 L4H scFv (SEQ ID NO: 109)
```
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSQYVMSWVRQAPGK
GLEWVSRIYPSGGVTKYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR
```

>620I-X0138-F02 = DX2930 Heavy Chain +
559C-M0192-F07 H4L scFv (SEQ ID NO: 110)
```
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSQYVMSWVRQAPGKGLEWVSRIYPSGGVTK
YADSVKGRFTISRDNSKNTLYLQMNSLRAEDTAVYYCTRQRYRGPKYYYY
MDVWGKGTTVTVSS
```

>620I-X0136-G04 = DX2930 Heavy Chain +
559C-M0192-G03 L4H scFv (SEQ ID NO: 111)
```
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSQYNMVWVRQAPGK
GLEWVSRIWPSGGKTTYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR
```

>620I-X0139-G12 = DX2930 Heavy Chain +
559C-M0192-G03 H4L scFv (SEQ ID NO: 112)
```
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
```

-continued

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGSGGGGSGGGGSGGGGSEVQLLESGG

GLVQPGGSLRLSCAASGFTFSQYNMVWVRQAPGKGLEWVSRIWPSGGKTT

YADSVKGRFTISRDNSKNTLYLQMNSLRAEDTAVYYCTRQRYRGPKYYYY

MDVWGKGTTVTVSS

>620I-X0136-B11 = DX2930 Heavy Chain +
559C-M0192-G05 L4H scFv
(SEQ ID NO: 113)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSQYTMVWVRQAPGK

GLEWVSRIYPSGGVTQYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0142-D04 = DX2930 Heavy Chain +
559C-M0192-G05 H4L scFv
(SEQ ID NO: 114)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGSGGGGSGGGGSGGGGSEVQLLESGG

GLVQPGGSLRLSCAASGFTFSQYTMVWVRQAPGKGLEWVSRIYPSGGVTQ

YADSVKGRFTISRDNSKNTLYLQMNSLRAEDTAVYYCTRQRYRGPKYYYY

MDVWGKGTTVTVSS

>620I-X0136-D06 = DX2930 Heavy Chain +
559C-M0192-H04 L4H scFv
(SEQ ID NO: 115)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSQYVMHWVRQAPGK

GLEWVSRIYPSGGLTNYADSVKGRFTISRDNSKNTLYLQMNSLRAEDTAV

YYCTRQRYRGPKYYYYMDVWGKGTTVTVSSGGGGSGGGGSGGGGSGGGGS

DIQMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGQGTKVEIKR

>620I-X0139-A01 = DX2930 Heavy Chain +
559C-M0192-H04 H4L scFv
(SEQ ID NO: 116)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGSGGGGSGGGGSGGGGSEVQLLESGG

GLVQPGGSLRLSCAASGFTFSQYVMHWVRQAPGKGLEWVSRIYPSGGLTN

YADSVKGRFTISRDNSKNTLYLQMNSLRAEDTAVYYCTRQRYRGPKYYYY

MDVWGKGTTVTVSS

>620I-X0136-D12 = DX2930 Heavy Chain +
559C-M0192-H11 L4H scFv
(SEQ ID NO: 117)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSQYVMHWVRQAPGK
GLEWVSSIWPSGGHTRYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR

>620I-X0138-F05 = DX2930 Heavy Chain + 
559C-M0192-H11 H4L scFv
(SEQ ID NO: 118)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSQYVMHWVRQAPGKGLEWVSSIWPSGGHTR
YADSVKGRFTISRDNSKNTLYLQMNSLRAEDTAVYYCTRQRYRGPKYYYY
MDVWGKGTTVTVSS >620I-X0136-A11 = DX2930 Heavy Chain + 
559C-M0292-D07 L4H scFv
(SEQ ID NO: 119)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSNYVMHWVRQAPGK
GLEWVSSIWPSGGKTKYADSVKGRFTISRDNSKNTLYLQMNSLRAEDTAV
YYCTRQRYRGPKYYYYMDAWGQGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0139-E05 = DX2930 Heavy Chain + 
559C-M0292-D07 H4L scFv
(SEQ ID NO: 120)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSDIQMTQSPLSLPVTPGEPASISCRSSQSLLHSNGYNYLDWYLQ
KPGQSPQLLIYLGSNRASGVPDRFSGSGSGTDFTLKISRVEAEDVGVYYC
MQALQTPWTFGQGTKVEIKRTGGGGSGGGGSGGGGSGGGGSEVQLLESGG
GLVQPGGSLRLSCAASGFTFSNYVMHWVRQAPGKGLEWVSSIWPSGGKTK
YADSVKGRFTISRDNSKNTLYLQMNSLRAEDTAVYYCTRQRYRGPKYYYY
MDAWGQGTTVTVSS >620I-X0136-C12 = DX2930 Heavy Chain + 
559C-M0177-A06 L4H scFv
(SEQ ID NO: 121)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GKSGGGSEVQLLESGGGLVQPGGSLRLSCAASGFTFSFSYSMHWVRQAPGK
GLEWVSRIYPSGGITSYADSVKGRFTISRDNSKNTLYLQMNSLRAEDTAV
YYCTRQRYRGPKYYYYMDVWGKGTTVTVSSGGGGSGGGGSGGGGSGGGGS
DIQMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGQGTKVEIKR >620I-X0138-E05 = DX2930 Heavy Chain + 
559C-M0177-A06 H4L scFv
(SEQ ID NO: 122)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL -continued

```
VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSDIQMTQSPLSLPVTPGEPASISCRSSQSLLHSNGYNYLDWYLQ

KPGQSPQLLIYLGSNRASGVPDRFSGSGSGTDFTLKISRVEAEDVGVYYC

MQALQTPWTFGQGTKVEIKRTGGGGSGGGGSGGGGSGGGGSEVQLLESGG

GLVQPGGSLRLSCAASGFTFSFYSMHWVRQAPGKGLEWVSRIYPSGGITS

YADSVKGRFTISRDNSKNTLYLQMNSLRAEDTAVYYCTRQRYRGPKYYYY

MDVWGKGTTVTVSS
```

Figure 10:
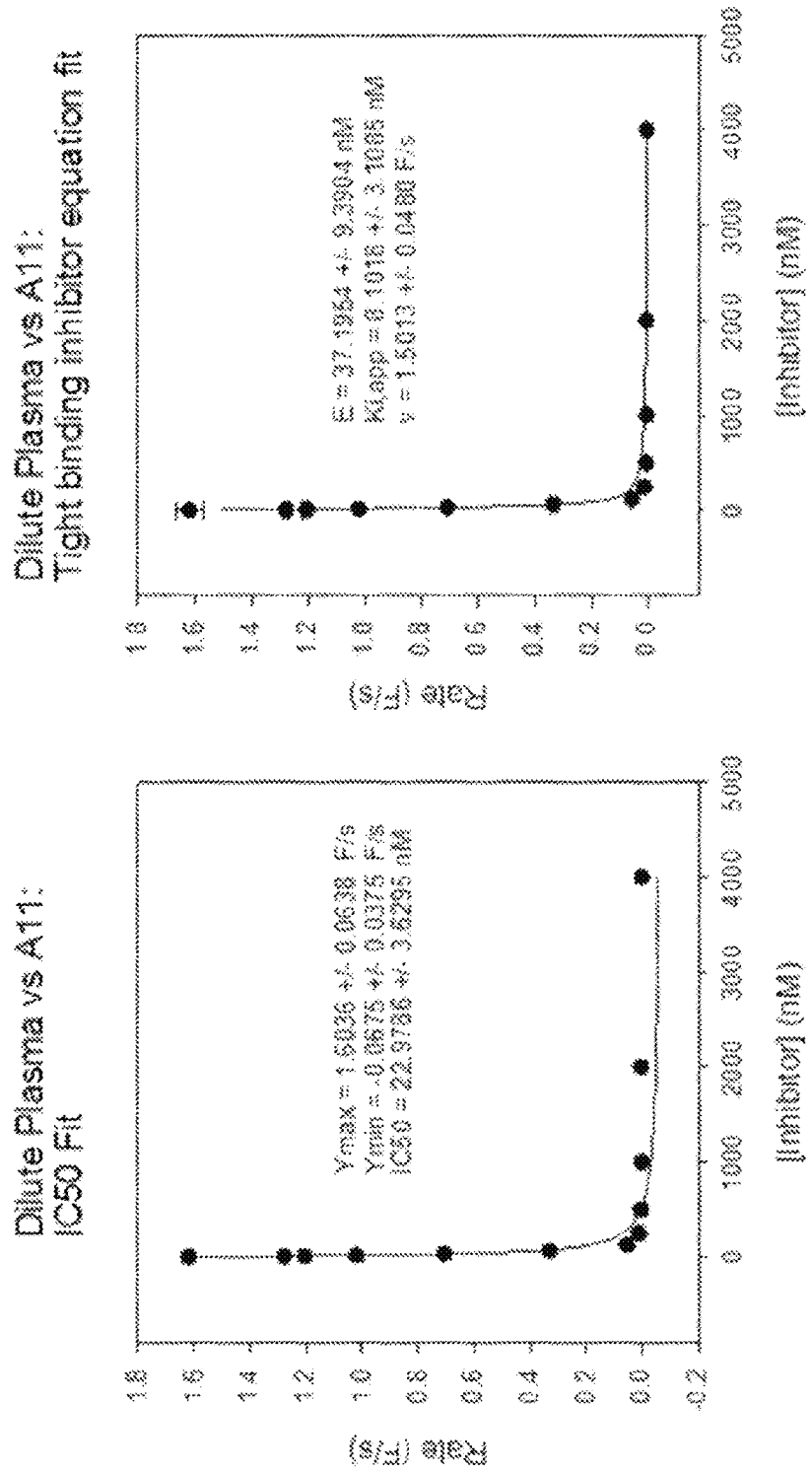
FIG. 10 includes graphs showing IC50 and Ki, apparent calculations of 3 disulfide-constrained bispecific antibodies in Plasma Inhibition Assay. A and B: clone 620I-X0173-A11. C and D: clone 620I-X0173-007. E and F: clone 620I-X0173-G11.
Figure 10:
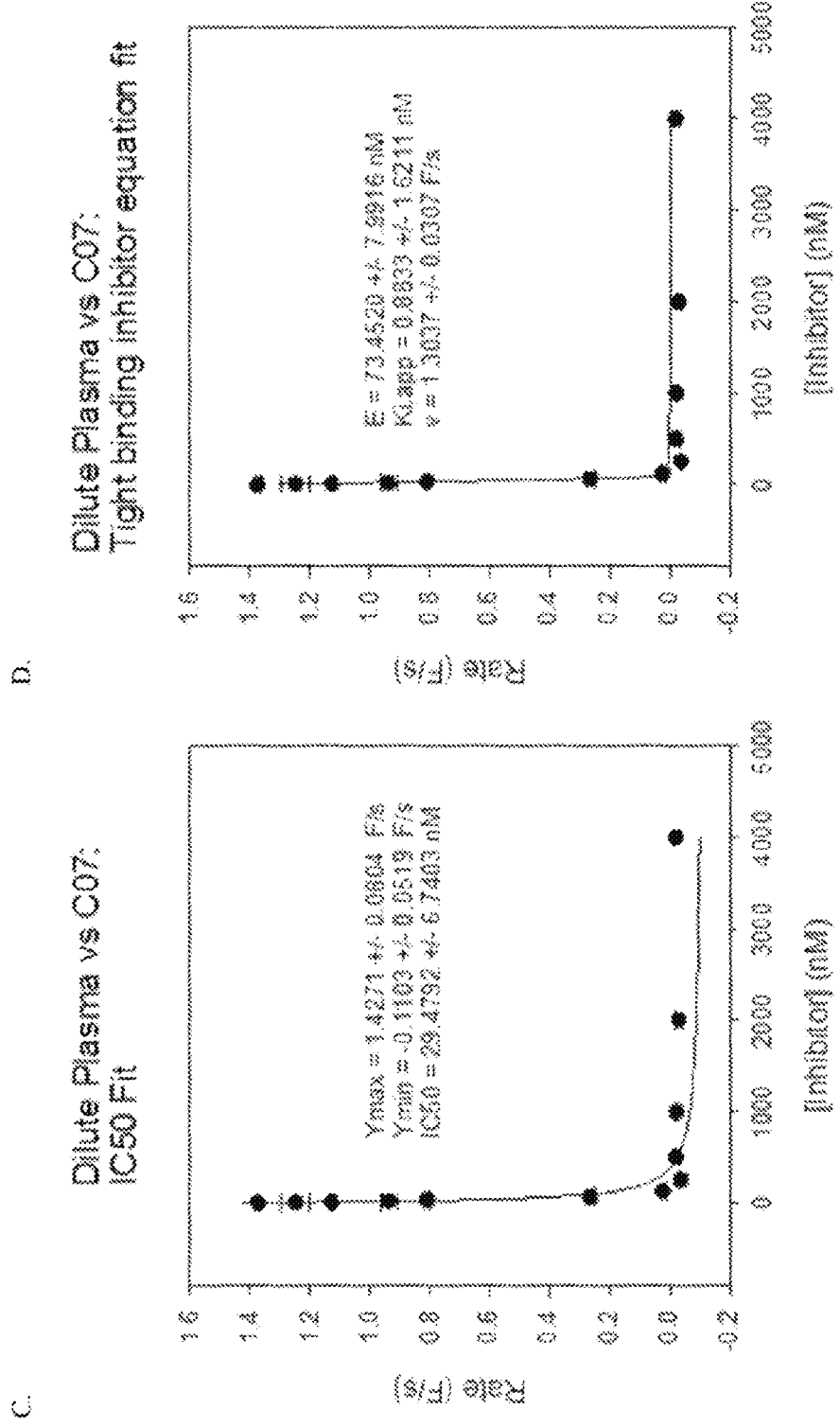

Example 3: Construction and Characterization of Exemplary Bispecific Antibodies that Contain Disulfide Bond To combat these aggregates, a disulfide bond between the VH residue 44 ($C_{44}$) and VL residue 100 ($C_{100}$) was engineered into the scFv region for 4 clones, 620I-X0177-A01 (620I-X0173-A11), 620I-X0177-C01 (620I-X0173-007), 620I-X0177-E01 (620I-X0173-E07), and 620I-X0177-G01 (620I-X0173-G11). SEC analysis of the bispecifics containing scFvs with disulfides showed dramatic reduction of the high molecular weight peaks, bringing the ranges down to 1-2%. FIG. 4. This reduction of aggregation applied across all concentrations tested. Biacore of these bispecific clones showed tight, specific binding to pKal and FXIIa (FIG. 9). The plasma inhibition of these isolates ranged from the 0.5 to 8 nM range (FIG. 10).

Figure 11:
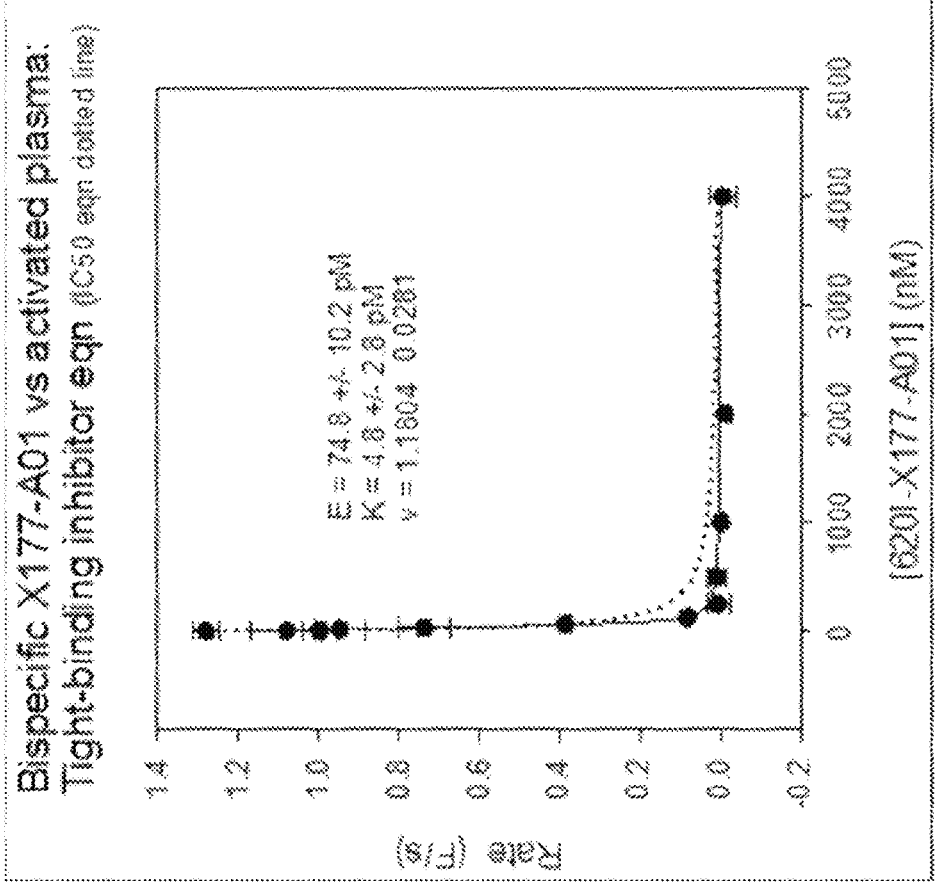
FIG. 11 is a graph showing the inhibitory features of bispecific antibody 620I-X0177-A01 (a.k.a. 620I-X0173-A11) as determined in Plasma Inhibition Assay.

The plasma inhibition assay as described herein was performed to determine the inhibitory activity of bispecific antibody 620I-X0177-A01. The plasma was diluted 1:40 and the inhibitors were added to the diluted plasma. 2.5% (final concentration) of a dilute Ellagic Acid solution was added to the plasma. Around 2 minutes later, activation of plasma was quenched by addition of CTI. The pKal activity in the plasma was measured by addition of a profluorescecent substrate as described herein. The results thus obtained were shown in FIG. 11.

Figure 12:
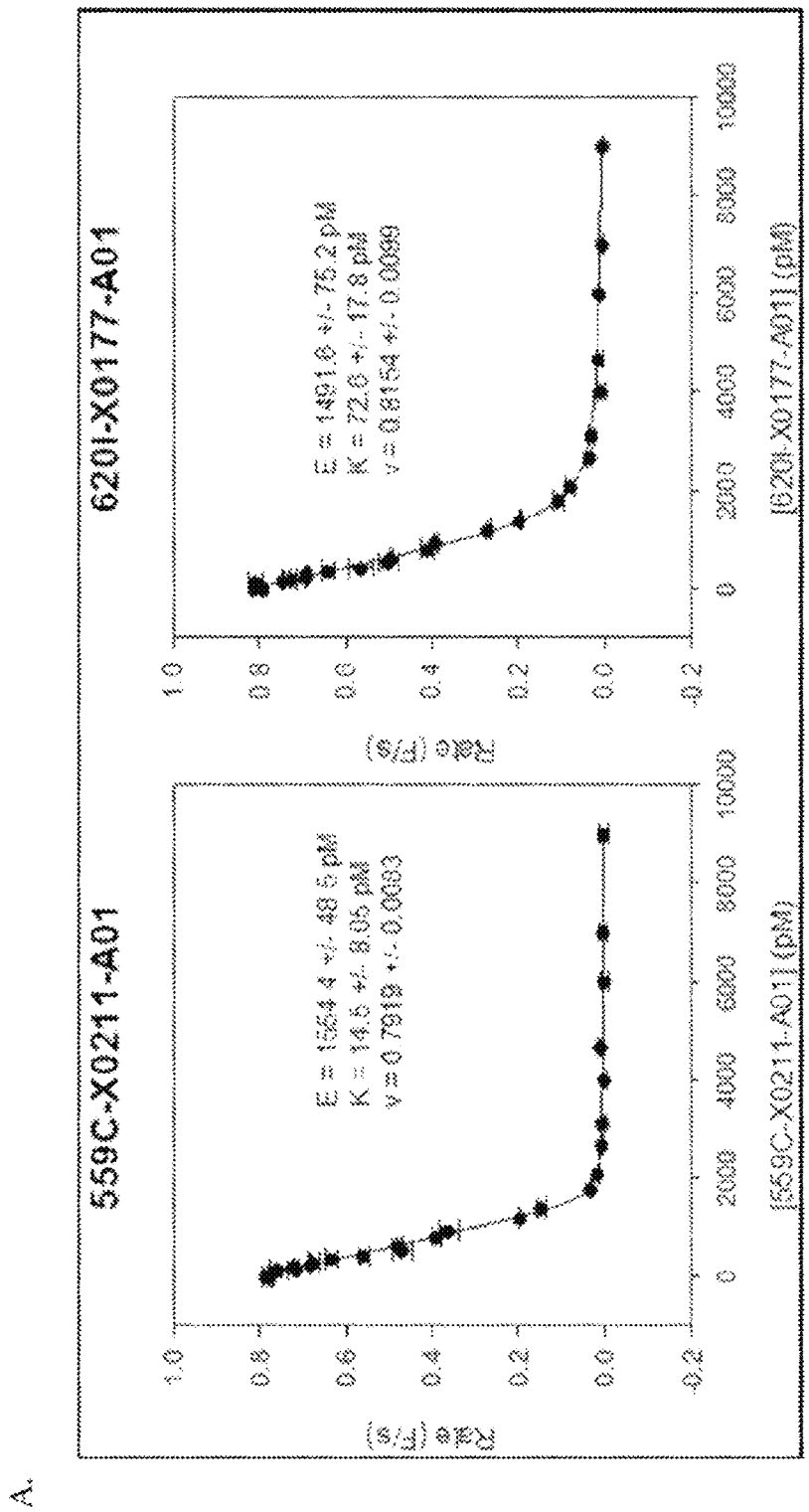
FIG. 12 includes graphs showing that there are drop-offs in affinity between the parent IgGs and the bispecific antibodies. A: binding features of parent clone 559C-X0211-A01 (left panel) and bispecific antibody 620I-X0177-A01 (right panel). B: binding features of parent clone DX-2930 (left panel) and bispecific antibody A01 (right panel).

The inhibitory activity of clone 620I-X0177-A01 was compared with that of the parent antibodies, either alone or in combination. Drop-offs in affinity were observed between the parental IgGs and the bispecific antibody. FIG. 12.

Figure 13:
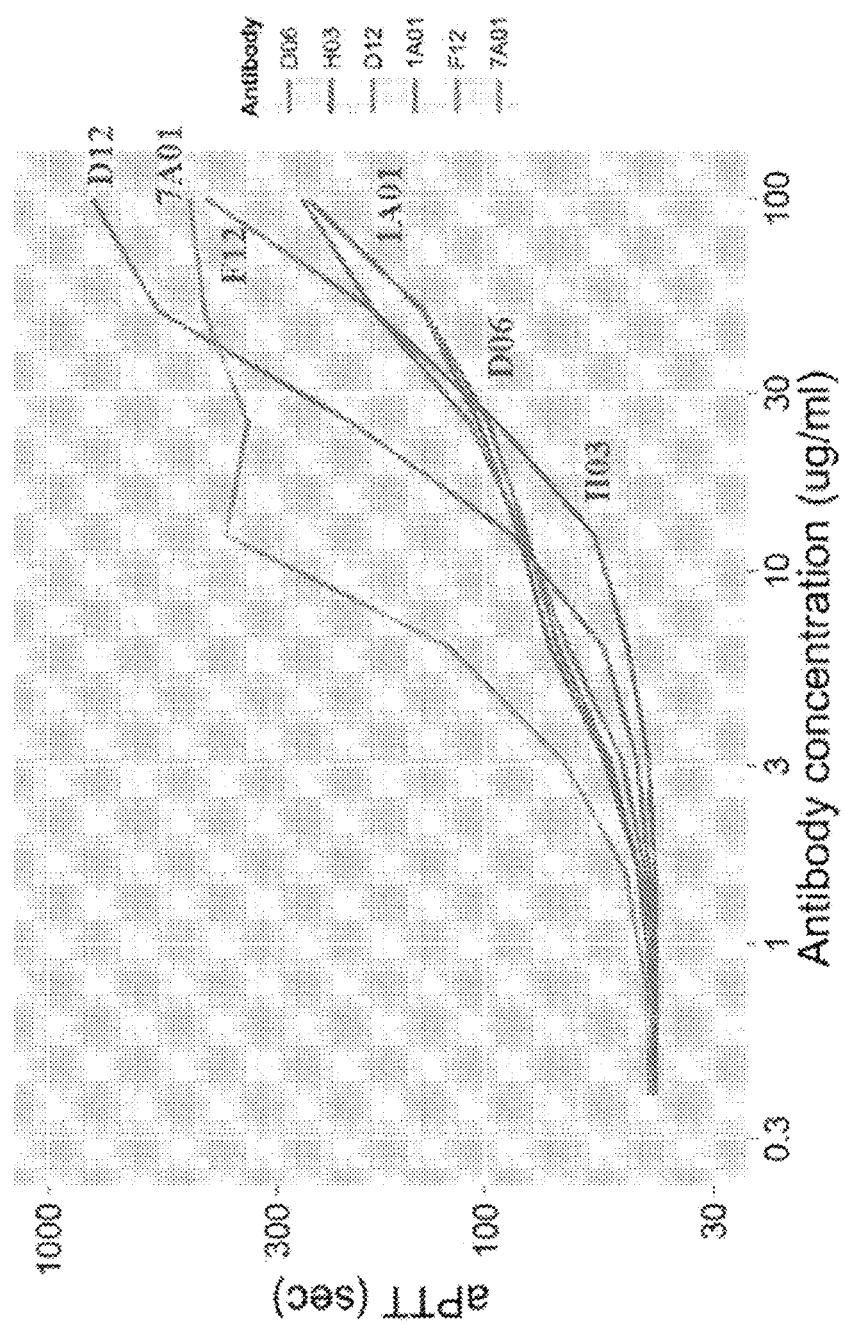
FIG. 13 is a chart showing dose-dependent delay of APTT by various antibodies as indicated. Clones D06, 1A01 and F12 are anti-FXIIa antibodies. Clone H03 is an anti-pKal antibody. Clones D12 and 7A01 are bispecific antibodies without and with disulfide bond, respectively.

Further, the abilities of various bispecific antibodies on APTT were assessed following the methods described herein. All tested antibodies showed dose-dependent delay of APTT. FIG. 13.

Figure 14:
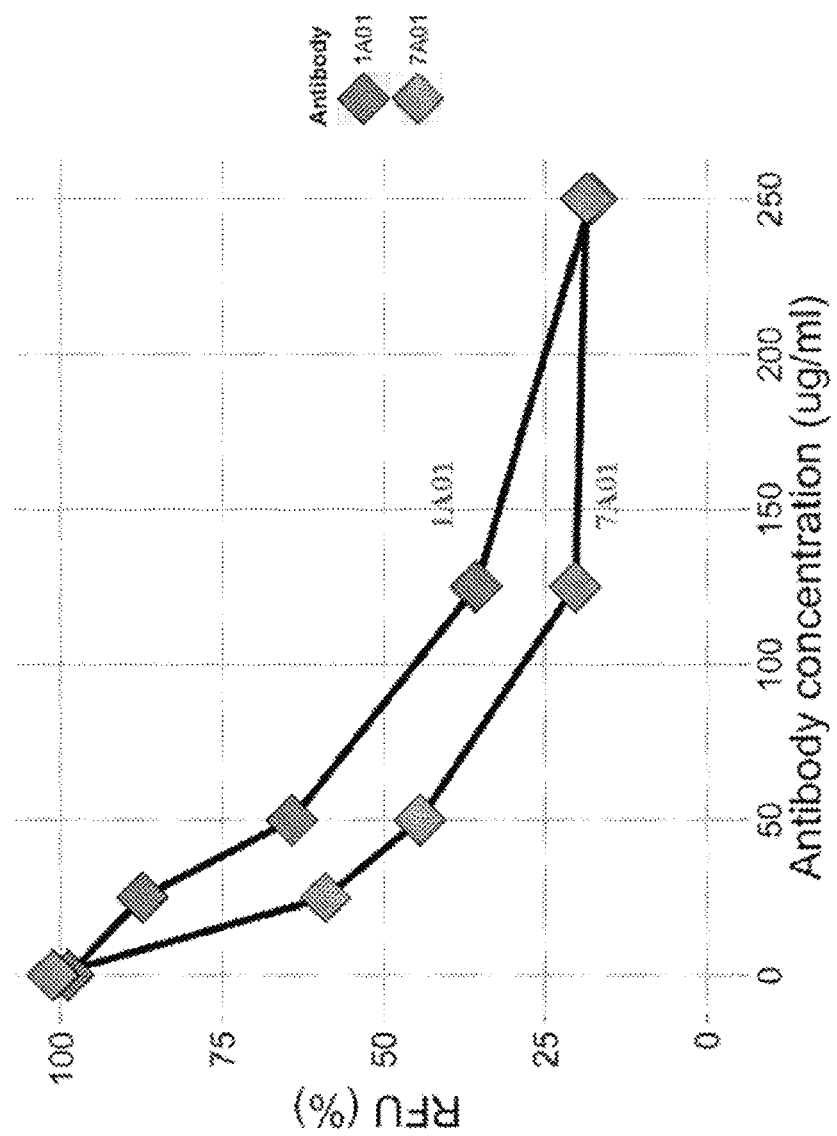
FIG. 14 is a chart showing dose-dependent delay of fibrin deposition by clones 1A01 (559C-X211-A01) and 7A01 (620I-X0177-A01).

The abilities of antibody clones 1A01 (anti-FXIIa) and 7A01 (bispecific against both pKal and FXII) to inhibit fibrin deposition were also examined and the results are shown in FIG. 14. A dose-dependent inhibition of fibrin deposition was observed.

Overall, enzyme inhibition assays determined that the apparent Ki values of the individual anti-pKal and anti-FXIIa components of the exemplary bispecific antibody 620I-X0177-A01 were similar to the parental molecules, with apparent Ki values of 389 pM and 73 pM, respectively.

Surprisingly, additional experiments in contact-activated dilute plasma reveal that this bispecific antibody was >5 times more effective at preventing pKal generation than a 1:1 combination of the parent antibodies, and >20-fold more effective than either of the parent antibodies alone. These data suggest that a bispecific antibody would be uniquely potent in its ability to shut down the positive feedback loop of contact system activation.

The sequences of the bispecific antibodies with disulfide constrained scFvs are provided below:

```
> 620I-X0173-A11 (620I-X0177-A01) =
620I-X0136-D12 Germlined + Gene
optimized scFv + disulfide stabilization
                                (SEQ ID NO: 47)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSQYVMHWVRQAPGK

CLEWVSSIWPSGGHTRYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

>620I-X0173-C07 (620I-X0177-C01) =
620I-X0136-C05 Germlined + Gene optimized
scFv + disulfide stabilization
                                (SEQ ID NO: 48)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYVMHWVRQAPGK

CLEWVSSIYPSGGKTSYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR
```

>620I-X0173-E07 (620I-X0177-E01) =
620I-X0136-C11 Germlined + Gene optimized
scFv + disulfide stabilization
(SEQ ID NO: 49)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSWYSMHWVRQAPGK

CLEWVSVIYPSGGKTRYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

>620I-X0173-G11 (620I-X0177-G01) =
620I-X0136-G05 Germlined + Gene optimized
scFv + disulfide stabilization
(SEQ ID NO: 50)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GKSGGGSEVQLLESGGGLVQPGGSLRLSCAASGFTFSHYVMHWVRQAPGK

CLEWVSSIYPSGGLTKYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

Figure 15:
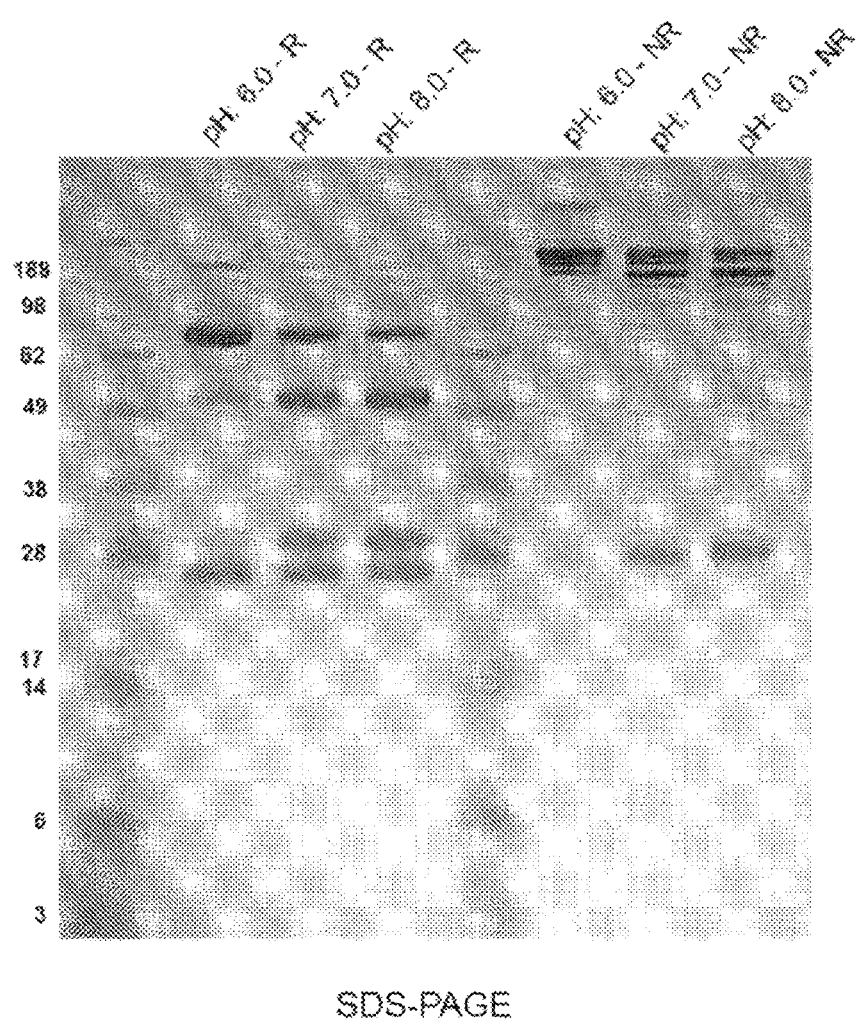
FIG. 15 is a SDS-PAGE protein gel showing samples of the bispecific antibody 620I-X0177-A01 under reduced conditions (lanes 2-4) and non-reduced conditions (lanes 6-8).
Figure 16:
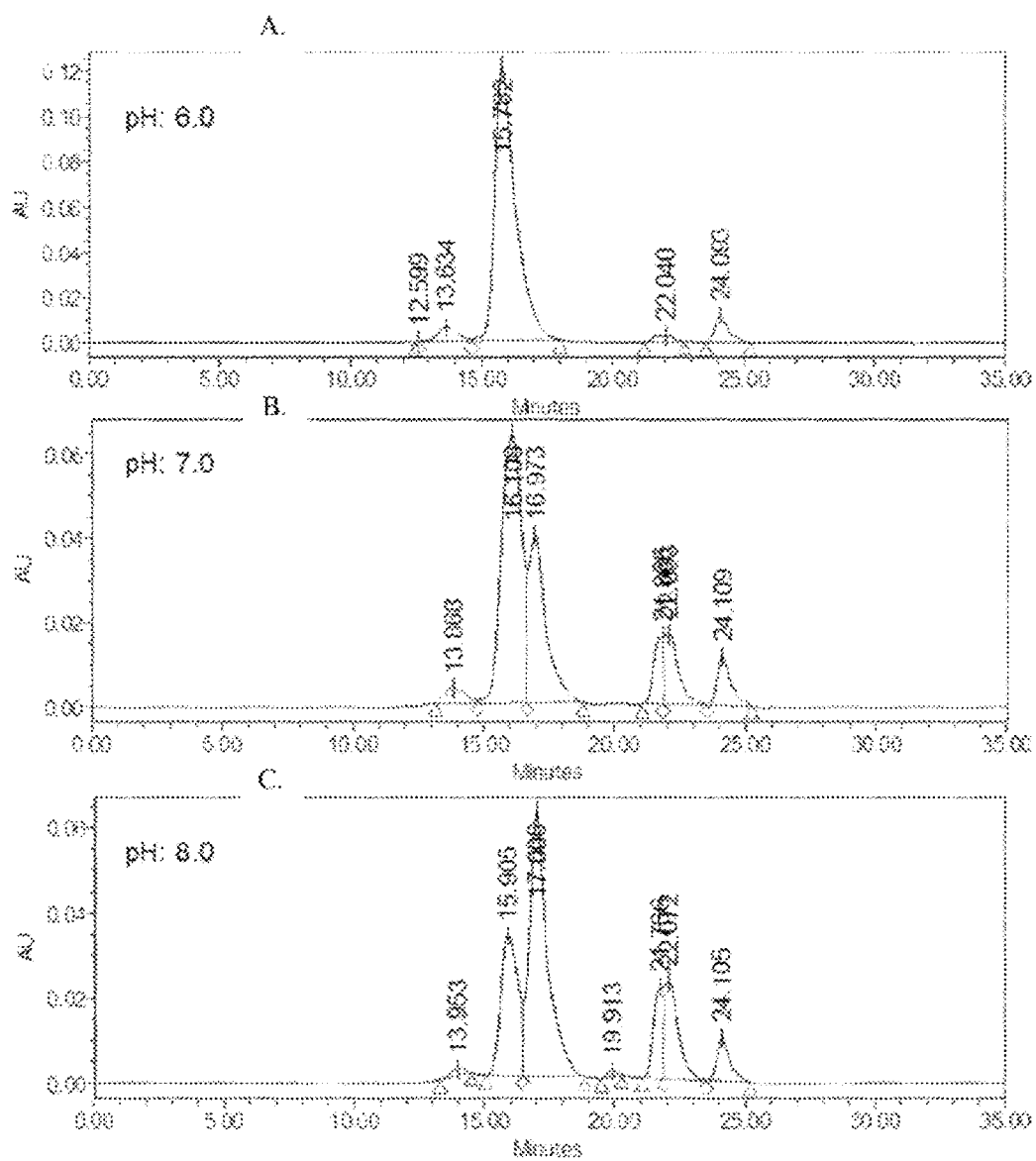
FIG. 16 includes graphs showing the analytical size exclusion chromatography (SEC) traces of the bispecific antibody 620I-X0177-A01 demonstrating pH dependent cleavage. The peaks between 15.7-16.1 minutes represent the correctly formed bispecific antibody. The peaks at 17 minutes represent DX-2930 IgG1. The peaks at 22 minutes represent the cleaved single chain antibody. A: pH 6.0. B: pH 7.0. C: 8.0.

Example 4: Construction and Characterization of Exemplary Bispecific Antibodies with C-Terminal Mutations and/or Deletions Exemplary bispecific antibodies (620I-X0177-A01, 620I-X0177-C01, 620I-X0177-E01, 620I-X0177-G01) were assessed for production and manufacturability. Samples of the bispecific antibodies were incubated at room temperature for 48 hours at various pH prior to analysis. The samples were then separated on a SDS-PAGE protein gel, as shown, for example, for bispecific antibody 620I-X0177-A01 in FIG. 15, or analyzed by size exclusion chromatography (FIG. 16A-16C). A pH-dependent increase of the 30 kDa and 50 kDa bands and a decrease of the 80 kDa bands were observed under reducing conditions (FIG. 15, lanes 2-6). The appearance of these unexpected bands indicating that the bispecific antibodies were undergoing unanticipated proteolytic cleavage. The appearance of the same 30 kDa species under non-reducing conditions indicated the cleaved species was monomeric (FIG. 15, lanes 6-8). By SEC analysis, peaks were observed at 15.7-16.1 minutes representing the correctly formed bispecific antibodies, at 17 minutes representing DX-2930, and at 22 minutes representing the cleaved single chain antibody (FIG. 16).

Exemplary bispecific antibodies were designed to remove the IgG1 heavy chain C-terminal lysine residue or mutate the lysine to a glycine residue.

Provided below are the amino acid sequences of the first polypeptides of the bispecific antibodies including a deletion of the C-terminal lysine residue or a mutation of the C-terminal lysine to a glycine residue of the heavy chain of the first antibody. These first polypeptides may be paired with the light chain of DX-2930.

>620I-X0179-A09 (620I-X0177-A01 with
IgG-C-term Lys deletion)
(SEQ ID NO: 141)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSQYVMHWVRQAPGKC

LEWVSSIWPSGGHTRYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEIKR

>620I-X0179-C01 (620I-X0177-A01 with
IgG-C-term Lys mutation to Gly)
(SEQ ID NO: 142)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSQYVMHWVRQAPGK

CLEWVSSIWPSGGHTRYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

>620I-X0179-E05 (620I-X0177-C01 with
IgG-C-term Lys deletion)
(SEQ ID NO: 143)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSWYVMHWVRQAPGKC

LEWVSSIYPSGGKTSYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEIKR

>620I-X0179-G05 (620I-X0177-C01 with
IgG-C-term Lys mutation to Gly)
(SEQ ID NO: 144)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSWYVMHWVRQAPGK

CLEWVSSIYPSGGKTSYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

>620I-X0180-A05 (620I-X0177-G01 with
IgG-C-term Lys deletion)
(SEQ ID NO: 145)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSHYVMHWVRQAPGKC

LEWVSSIYPSGGLTKYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEIKR

>620I-X0180-C11 (620I-X0177-G01 with
IgG-C-term Lys mutation to Gly)
(SEQ ID NO: 146)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSHYVMHWVRQAPGK

CLEWVSSIYPSGGLTKYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR

>620I-X0180-E07 (620I-X0177-E01 with
IgG-C-term Lys deletion)
(SEQ ID NO: 147)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

```
YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSWYSMHWVRQAPGKC

LEWVSVIYPSGGKTRYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEIKR

>620I-X0180-G03 (620I-X0177-E01 with
IgG-C-term Lys mutation to Glycine)
                                (SEQ ID NO: 148)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSWYSMHWVRQAPGK

CLEWVSVIYPSGGKTRYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEIKR
```

Figure 17:
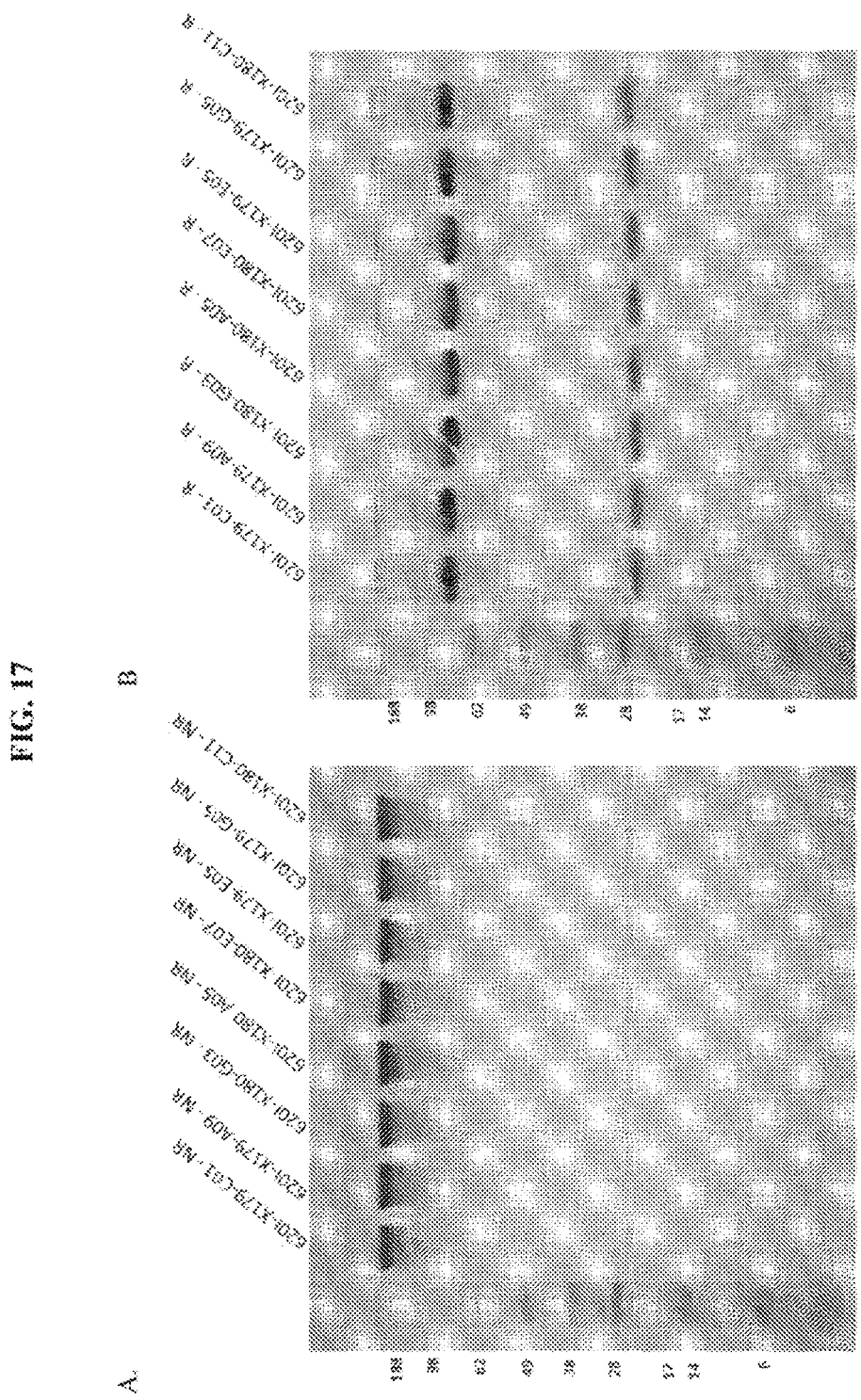
FIG. 17 includes SDS-PAGE protein gels of the indicated bispecific antibodies, which are engineered to either mutate or delete the IgG C-terminal Lysine at t=0. A: non-reduced conditions. B: reduced conditions.
Figure 18:
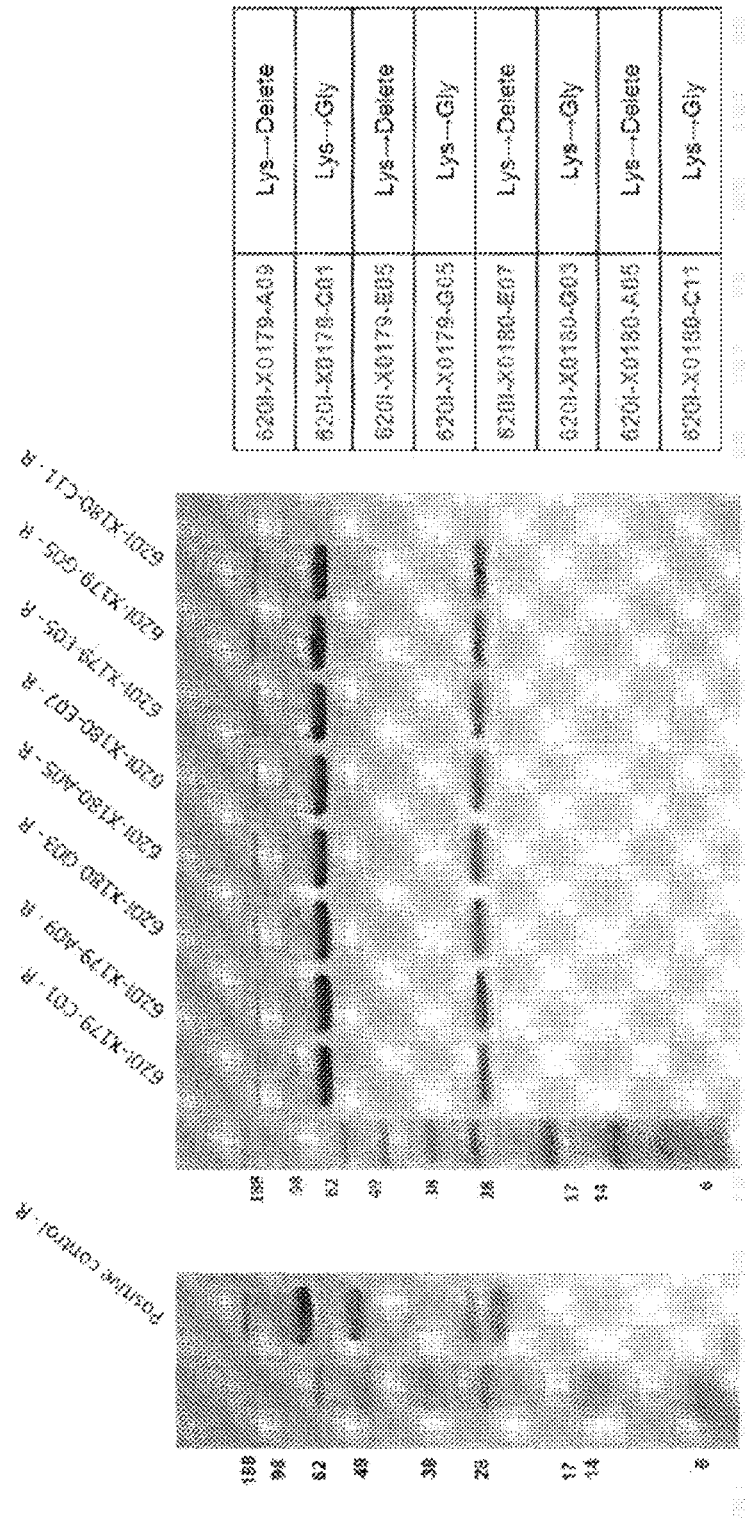
FIG. 18 shows a SDS-PAGE protein gel including the indicated bispecific antibodies engineered to either mutate or delete the IgG C-terminal lysine at t=48 hr under reduced conditions. The positive control is bispecific antibody 620I-X0177-A01.

Each of the exemplary bispecific antibodies including a deletion of the C-terminal lysine residue or a mutation of the C-terminal lysine to a glycine residue of the heavy chain of the first antibody was assessed by separating the bispecific antibodies on an SDS-PAGE gel at t=0 (FIG. 17). Samples of each of the exemplary hi specific antibodies were also concentrated using an Amicon 10 kDa molecular weight cut-off spin filter to approximately 10 mg/mL in 50 mM Hepes, pH 7.5 and incubated at room temperature for 48 hours. The samples were then assessed by SDS-PAGE gel (FIG. 18). In each case, deletion or mutation of the C-terminal lysine reduced or eliminated cleavage of the scFv from the bispecific antibody.

Figure 19:
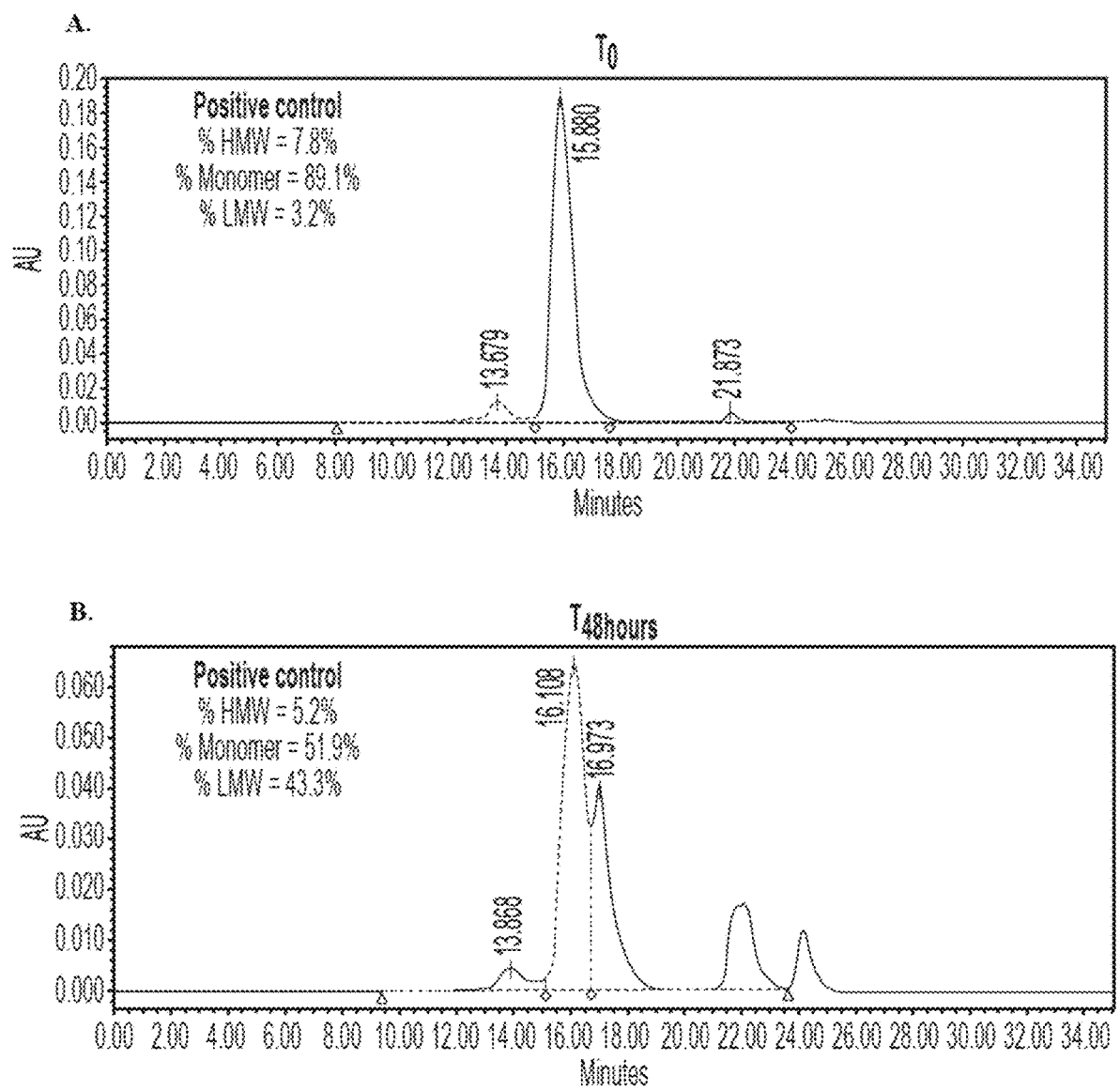
FIG. 19 includes graphs showing the analytical size exclusion chromatography (SEC) traces of control bispecific antibody 620I-X0177-A01. The peaks between 15.7-16.1 minutes represent the correctly formed bispecific antibody. The peaks at 17 minutes represent DX-2930 IgG1. The peaks at 22 minutes represent the cleaved single chain antibody. A: t=0. B: t=48 hrs.
Figure 21:
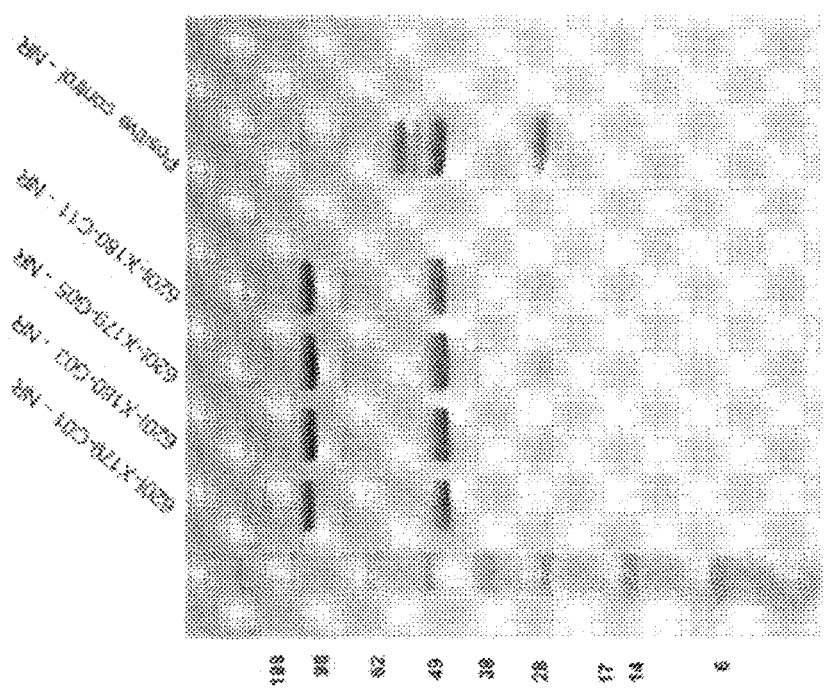
FIG. 21 shows a SDS-PAGE protein gel showing the indicated bispecific antibodies engineered to either mutate or delete the heavy chain IgG C-terminal lysine under non-reduced conditions. The positive control is 620I-X0177-A01. Samples were incubated with Endoproteinase Lys C at 37° C. for 1 hour.

Samples of the bispecific were also assessed by analytical size exclusion chromatography, demonstrating that the deletion or mutation of the C-terminal lysine reduced cleavage of the bispecific antibodies (FIGS. 19-20). Cleavage of the bispecific antibodies was also assessed by incubating the antibodies with EndoLysC at 37° C. for 1 hour followed by separation on an SDS-PAGE gel (FIG. 21). The protein bands at 50 kDa corresponded to the Fab portion of DX-2930, and the bands at 100 kDa corresponded to a homodimer of Fc-scFv, further indicating that the deletion or mutation of the heavy chain C-terminal lysine reduced cleavage of the bispecific antibodies.

Figure 22:
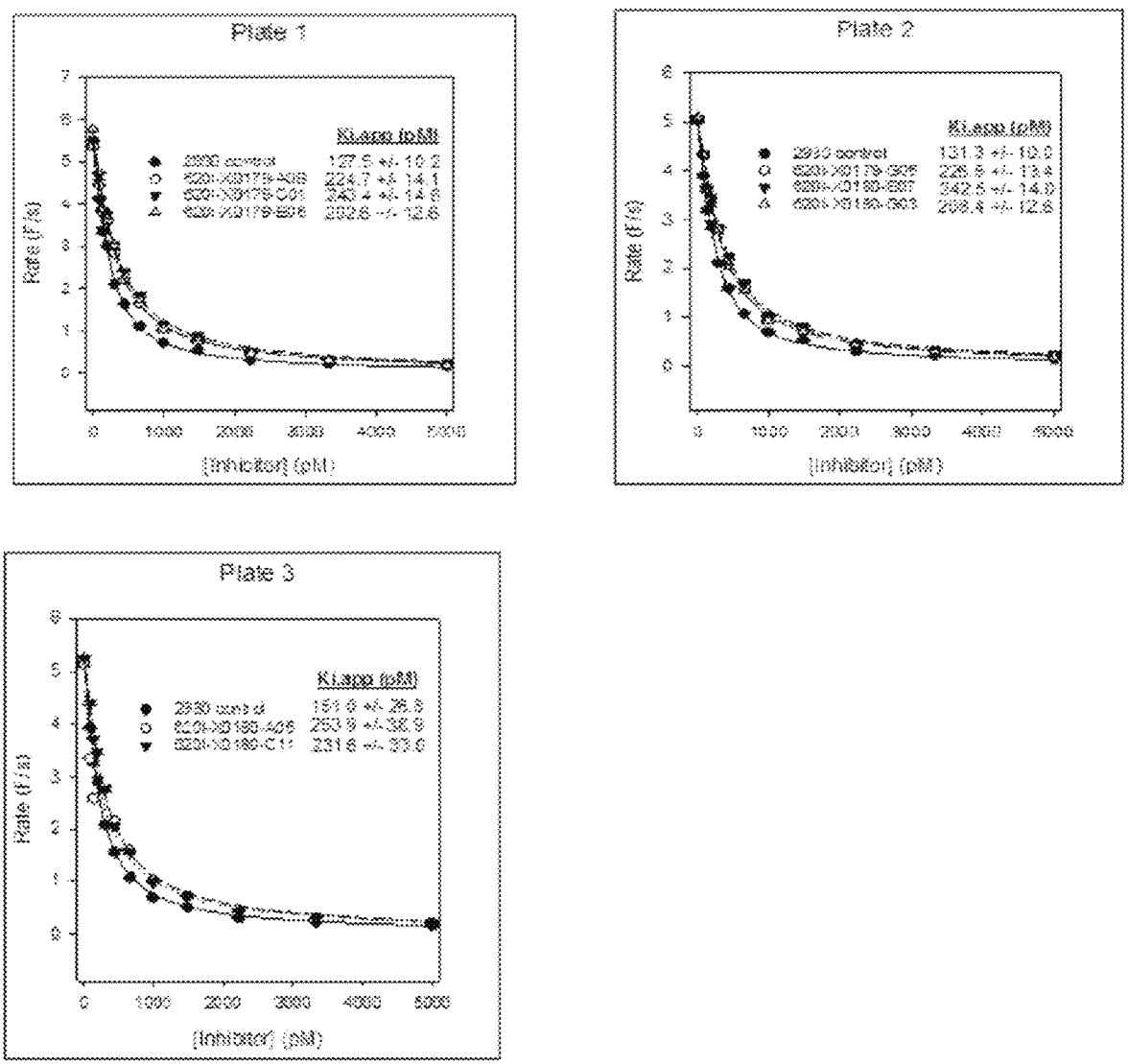
FIG. 22 includes graphs showing pKal inhibition by example bispecific antibodies. Plate 1 shows inhibition features of bispecific antibodies 620I-X0179-A09 (open circles), 620I-X0179-001 (closed triangles), and 620I-X0179-E05 (open triangles). Plate 2 shows inhibition features of bispecific antibodies 620I-X0179-G05 (open circles), 620I-X0180-E07 (closed triangles), and 620I-X0180-G03 (open triangles). Plate 3 shows inhibition features of bispecific antibodies 620I-X0180-A05 (open circles) and 620I-X0180-C11 (closed triangles). The antibody DX-2930 was used as a control on each of the plates.
Figure 23:
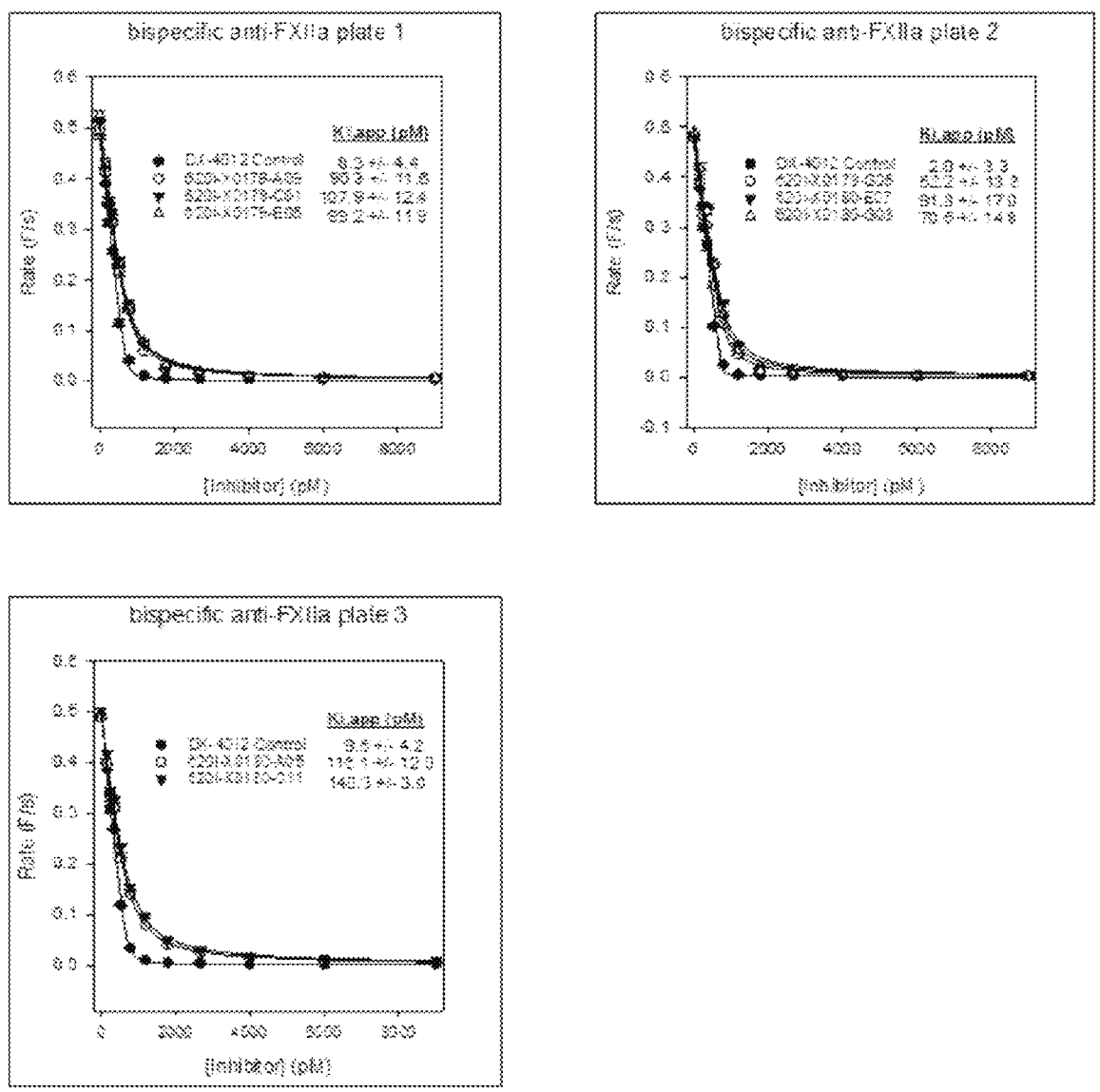
FIG. 23 includes graphs showing FXIIa inhibition by example bispecific antibodies. Plate 1 shows inhibition features of bispecific antibodies 620I-X0179-A09 (open circles), 620I-X0179-001 (closed triangles), and 620I-X0179-E05 (open triangles). Plate 2 shows inhibition features of bispecific antibodies 620I-X0179-G05 (open circles), 620I-X0180-E07 (closed triangles), and 620I-X0180-G03 (open triangles). Plate 3 shows inhibition features of bispecific antibodies 620I-X0180-A05 (open circles) and 620I-X0180-C11 (closed triangles). The antibody DX-4012 (559C-M0192-H11) was used as a control on each of the plates.
Figure 24:
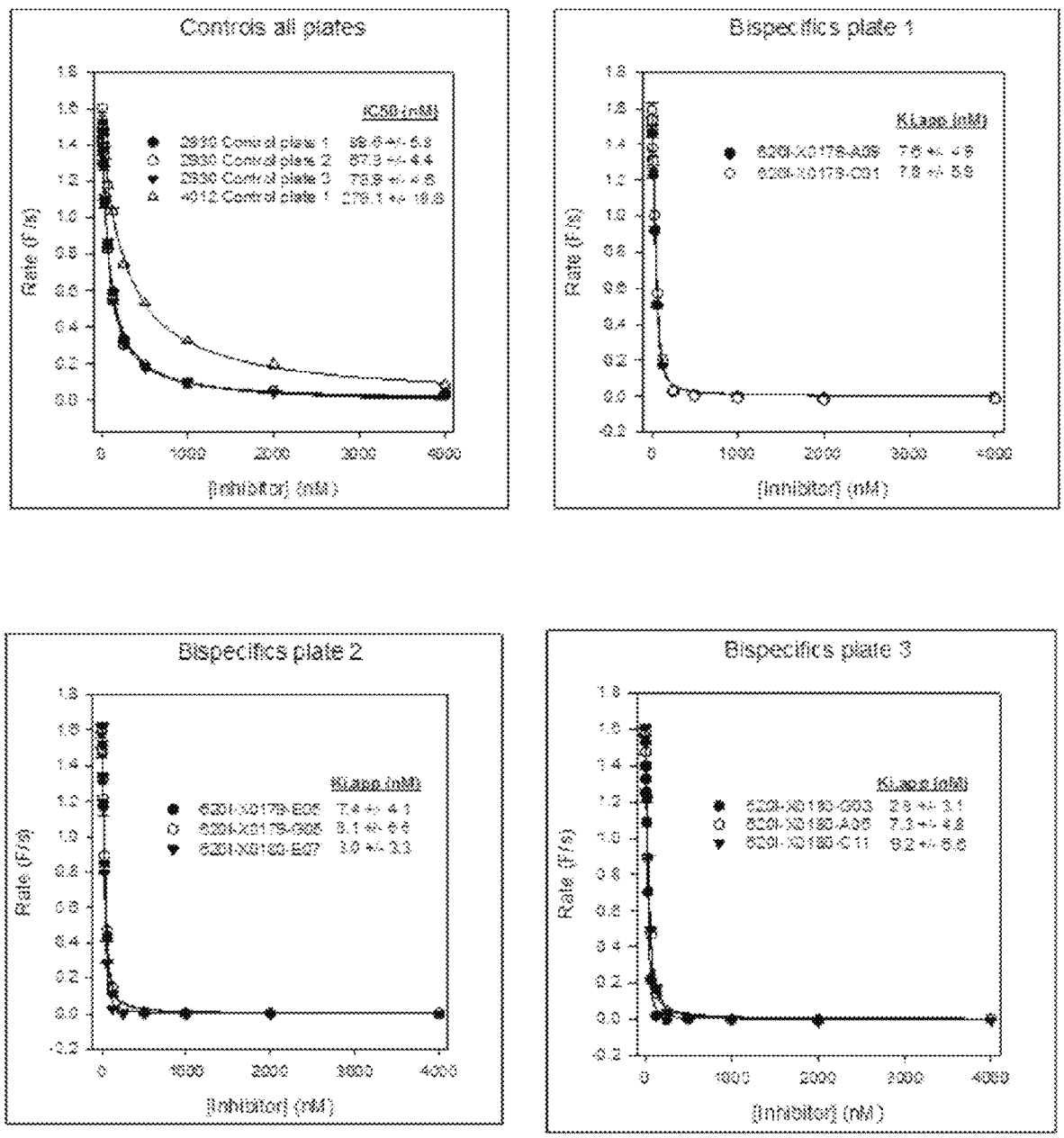
FIG. 24 includes graphs showing inhibition of activated plasma by example bispecific antibodies. The top left panel shows inhibition features of DX-2930 from control plates 1, 2, and 3, and DX-4012. The top right panel shows inhibition features of bispecific antibodies 620I-X0179-A09 (closed circles), 620I-X0179-001 (open circles). The bottom left panel shows inhibition features of bispecific antibodies 620I-X0179-E05 (closed circles), 620I-X0179-G05 (open circles), and 620I-X0180-E07 (closed triangles). The bottom right panel shows inhibition features of bispecific antibodies 620I-X0180-G03 (closed circles), 620I-X0180-A05 (open circles), and 620I-X0180-C11 (closed triangles).

The exemplary bispecific antibodies including a deletion or mutation of the C-terminal lysine were also characterized for the ability to inhibit pKal, FXIIa, and activated plasma compared to DX-2930 and DX-4012 control (Table 1, FIG. 22-24). Each of the exemplary bispecific antibodies was found to be functionally equivalent to the parent bispecific antibody (the bispecific antibody that does not comprise the deletion or mutation of the IgG1 heavy chain C-terminal lysine). The mutation may reduce charge heterogeneity of the bispecific antibody.

TABLE 6

Summary of bispecific antibodies used in the biochemical assays, as well as DX-2930 and DX-4012 control IgGs.
Assays were performed to measure inhibition of pKal, inhibition of FXIIa, and inhibition of activated plasma.

| R-name | X-name (or DX-) | Parent Bispecific | IgG-C-term Lys alteration | FXII scFv |
|---|---|---|---|---|
| 620I-R0052-A01 | 620I-X0179-A09 | 620I-X0177-A01 | Lys-Delete | 559C-M0192-H11 GL/GO/Disulfide H4L scFv |
| 620I-R0052-C01 | 620I-X0179-C01 | 620I-X0177-A01 | Lys-Gly | 559C-M0192-H11 GL/GO/Disulfide H4L scFv |
| 620I-R0052-E01 | 620I-X0179-E05 | 620I-X0177-C01 | Lys-Delete | 559C-M0192-F06 GL/GO/Disulfide H4L scFv |
| 620I-R0052-G01 | 620I-X0179-G05 | 620I-X0177-C01 | Lys-Gly | 559C-M0192-F06 GL/GO/Disulfide H4L scFv |
| 620I-R0052-E03 | 620I-X0180-E07 | 620I-X0177-E01 | Lys-Delete | 559C-M0191-E09 GL/GO/Disulfide H4L scFv |
| 620I-R0052-G03 | 620I-X0180-G03 | 620I-X0177-E01 | Lys-Gly | 559C-M0191-E09 GL/GO/Disulfide H4L scFv |
| 620I-R0052-A03 | 620I-X0180-A05 | 620I-X0177-G01 | Lys-Delete | 559C-M0192-A01 GL/GO/Disulfide H4L scFv |
| 620I-R0052-C03 | 620I-X0180-C11 | 620I-X0177-G01 | Lys-Gly | 559C-M0192-A01 GL/GO/Disulfide H4L scFv |
|  | DX-2930 |  |  |  |
|  | DX-4012 |  |  |  |

| R-name | pKal inhibition Ki, app (pM) | FXIIa inhibition Ki, app (pM) | activated plasma inhibition IC50/Ki, app (nM) |
|---|---|---|---|
| 620I-R0052-A01 | 225 | 90 | 7.6 (Ki) |
| 620I-R0052-C01 | 243 | 108 | 7.8 (Ki) |
| 620I-R0052-E01 | 203 | 99 | 7.4 (Ki) |
| 620I-R0052-G01 | 226 | 52 | 8.1 (Ki) |
| 620I-R0052-E03 | 243 | 92 | 3.0 (Ki) |
| 620I-R0052-G03 | 208 | 71 | 2.8 (Ki) |
| 620I-R0052-A03 | 254 | 116 | 7.3 (Ki) |

TABLE 6-continued

Summary of bispecific antibodies used in the biochemical assays, as well as DX-2930 and DX-4012 control IgGs.
Assays were performed to measure inhibition of pKal, inhibition of FXIIa, and inhibition of activated plasma.

| | | | |
|---|---|---|---|
| 620I-R0052-C03 | 232 | 140 | 9.2 (Ki) |
| | 127, 131, 151 | n/a | 90, 68, 74, 74, 66 (IC50) |
| | n/a | 8, 2, 9 | 279, 291 (IC50) |

Alternatively or in addition, the Lys-Arg (KR) motif at the C-terminus of the anti-FXIIa scFvs noted above can be removed. Provided below are the amino acid sequences of the exemplary bispecific antibody polypeptides including a deletion of the C-terminal lysine residue or a mutation of the C-terminal lysine to a glycine residue of the heavy chain of the first antibody and a deletion of the C-terminal lysine-arginine residues of the scFv.

```
>620I-X0186-C05 (620I-X0177-A01 with
IgG-C-term Lys deletion and C-terminal KR removal)
                                      (SEQ ID NO: 151)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSQYVMHWVRQAPGKC

LEWVSSIWPSGGHTRYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEI

>620I-X0185-C01 (620I-X0177-A01 with IgG-C-term
Lys mutation to Glycine and C-terminal KR removal)
                                      (SEQ ID NO: 152)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSQYVMHWVRQAPGK

CLEWVSSIWPSGGHTRYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ

LLIYLGSNRASGVPDRFSGSGSGTDFTLKISRVEAEDVGVYYCMQALQTP

WTFGCGTKVEI

>620I-X0186-E05 (620I-X0177-C01 with IgG-C-term
Lys deletion and C-terminal KR removal)
                                      (SEQ ID NO: 153)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GSGGGSEVQLLESGGGLVQPGGSLRLSCAASGFTFSWYVMHWVRQAPGKC

LEWVSSIYPSGGKTSYADSVKGRFTISRDNSKNTLYLQMNSLRAEDTAVY

YCARQRYRGPKYYYYMDVWGQGTTVTVSSGGGGSGGGGSGGGGSGGGGSD

IVMTQSPLSLPVTPGEPASISCRSSQSLLHSNGYNYLDWYLQKPGQSPQL

LIYLGSNRASGVPDRFSGSGSGTDFTLKISRVEAEDVGVYYCMQALQTPW

TFGCGTKVEI

>620I-X0185-E01 (620I-X0177-C01 with IgG-C-term
Lys mutation to Glycine and C-terminal KR removal)
                                      (SEQ ID NO: 154)
EVQLLESGGGLVQPGGSLRLSCAASGFTFSHYIMMWVRQAPGKGLEWVSG

IYSSGGITVYADSVKGRFTISRDNSKNTLYLQMNSLRAEDTAVYYCAYRR

IGVPRRDEFDIWGQGTMVTVSSASTKGPSVFPLAPSSKSTSGGTAALGCL

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GGSGGGSEVQLLESGGGLVQPGGSLRLSCAASGFTFSWYVMHWVRQAPGK

CLEWVSSIYPSGGKTSYADSVKGRFTISRDNSKNTLYLQMNSLRAEDTAV

YYCARQRYRGPKYYYYMDVWGQGTTVTVSSGGGGSGGGGSGGGGSGGGGS

DIVMTQSPLSLPVTPGEPASISCRSSQSLLHSNGYNYLDWYLQKPGQSPQ
```

-continued
LLIYLGSNRASGVPDRFSGSGSGTDFTLKISRVEAEDVGVYYCMQALQTP
WTFGCGTKVEI

>620I-X0186-A05 (620I-X0177-G01 with IgG-C-term
Lys deletion and C-terminal KR removal)
(SEQ ID NO: 155)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GSGGGSEVQLLESGGGLVQPGGSLRLSCAASGFTFSHYVMHWVRQAPGKC
LEWVSSIYPSGGLTKYADSVKGRFTISRDNSKNTLYLQMNSLRAEDTAVY
YCARQRYRGPKYYYYMDVWGQGTTVTVSSGGGGSGGGGSGGGGSGGGGSD
IVMTQSPLSLPVTPGEPASISCRSSQSLLHSNGYNYLDWYLQKPGQSPQL
LIYLGSNRASGVPDRFSGSGSGTDFTLKISRVEAEDVGVYYCMQALQTPW
TFGCGTKVEI >620I-X0185-A03 (620I-X0177-G01 with IgG-C-term
Lys mutation to Glycine and C-terminal KR removal)
(SEQ ID NO: 156)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GGSGGGSEVQLLESGGGLVQPGGSLRLSCAASGFTFSHYVMHWVRQAPGK
CLEWVSSIYPSGGLTKYADSVKGRFTISRDNSKNTLYLQMNSLRAEDTAV
YYCARQRYRGPKYYYYMDVWGQGTTVTVSSGGGGSGGGGSGGGGSGGGGS
DIVMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGCGTKVEI >620I-X0186-G07 (620I-X0177-E01 with IgG-C-term
Lys deletion and C-terminal KR removal)
(SEQ ID NO: 157)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GSGGGSEVQLLESGGGLVQPGGSLRLSCAASGFTFSWYSMHWVRQAPGKC
LEWVSVIYPSGGKTRYADSVKGRFTISRDNSKNTLYLQMNSLRAEDTAVY
YCARQRYRGPKYYYYMDVWGQGTTVTVSSGGGGSGGGGSGGGGSGGGGSD
IVMTQSPLSLPVTPGEPASISCRSSQSLLHSNGYNYLDWYLQKPGQSPQL
LIYLGSNRASGVPDRFSGSGSGTDFTLKISRVEAEDVGVYYCMQALQTPW
TFGCGTKVEI >620I-X0185-G01 (620I-X0177-E01 with IgG-C-term
Lys mutation to Glycine and C-terminal KR removal)
(SEQ ID NO: 158)
EVQLLESGGGLVQPGGSLRLSCAASGFTFSHYIMMWVRQAPGKGLEWVSG
IYSSGGITVYADSVKGRFTISRDNSKNTLYLQMNSLRAEDTAVYYCAYRR
IGVPRRDEFDIWGQGTMVTVSSASTKGPSVFPLAPSSKSTSGGTAALGCL
VKDYFPEPVTVSWNSGALTSGVHTFPAVLQSSGLYSLSSVVTVPSSSLGT
QTYICNVNHKPSNTKVDKRVEPKSCDKTHTCPPCPAPELLGGPSVFLFPP
KPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSP
GGSGGGSEVQLLESGGGLVQPGGSLRLSCAASGFTFSWYSMHWVRQAPGK
CLEWVSVIYPSGGKTRYADSVKGRFTISRDNSKNTLYLQMNSLRAEDTAV
YYCARQRYRGPKYYYYMDVWGQGTTVTVSSGGGGSGGGGSGGGGSGGGGS
DIVMTQSPLSLPVTPGEPASISCRSSQSLLHSNGYNYLDWYLQKPGQSPQ
LLIYLGSNRASGVPDRFSGSGSGTDFTLKISRVEAEDVGVYYCMQALQTP
WTFGCGTKVEI The above-listed polypeptides can be paired with the light chain of DX-2930 to form bispecific antibodies, which are also within the scope of the present disclosure.

Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

SEQUENCE LISTING (164 sequences)

SEQ ID NO: 1 - protein, 122 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSS

SEQ ID NO: 2 - protein, 106 aa, Artificial Sequence
  Synthetic Polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIK

SEQ ID NO: 3 - protein, 123 aa, Artificial Sequence
  Synthetic Polypeptide
EVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 4 - protein, 123 aa, Artificial Sequence
  Synthetic Polypeptide
EVQLLESGGGLVQPGGSLRLSCAASGFTFSFYSMHWVRQAPGKGLEWVSRIYPSGGVTKYADSVKGRFTISRDNSKNTLYLQMNSLRAEDTAVYYCTRQRYRGPKYYYYMDVWGKGTTVTVSS

SEQ ID NO: 5 - protein, 113 aa, Artificial Sequence
  Synthetic Polypeptide
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 6 - protein, 112 aa, Artificial Sequence
  Synthetic Polypeptide
DIQMTQSPLSLSVAPGEPASISCRSSQSLLHRNGHNYLDWYLQKPGQSPQLLIYLGSNRASGVPERFSGSGSGTDFTLRISRVEAEDVGVYYCMQALQARTFGQGTKVEIKR

SEQ ID NO: 7 - protein, 112 aa, Artificial Sequence
  Synthetic Polypeptide
DIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTRTFGQGTKVEIKR

SEQ ID NO: 8 - protein, 113 aa, Artificial Sequence
  Synthetic Polypeptide
DIQMTQSPLSLPVTPGEPASISCRSSQSLLHSNGYNYLDWYLQKPGQSPQIMIYLGSNRASGVPDRFSGSGSGTDFTLKISRVEAEDVGVYYCMQALQTPRTFGQGTKVEIKR

SEQ ID NO: 9 - protein, 471 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 232 aa, Artificial Sequence
  Synthetic Polypeptide
MGWSCIILFLVATATGVHSDIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 731 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYSMHWVRQAPGKGLEWVSRIYPSGGVTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 12 - protein, 732 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYSMHWVRQAPGKGLEWVSRIYPSGGVTKYADSVKGRFTISRDNSKNTLYLQMNSLRAEDTAVYYCTRQRYRGPKYYYYMDVWGKGTTVTVSS

SEQ ID NO: 13 - protein, 730 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLSVAPGEPASISCRSSQSLLHRNGHNYLDWYLQKPGQSPQLLIYLGSNRASGVPERFSGSGSGTDFTLRISRVEAEDVGVYYCMQALQARTFGQGTKVEIKR

SEQ ID NO: 14 - protein, 731 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLSVAPGEPASISCRSSQSLLHRNGHNYLDWYLQKPGQSPQLLIYLGSNRASGVPERFSGSGSGTDFTLRISRVEAEDVGVYYCMQALQARTFGQGTKVEIKRTGGGGSGGGGSGGGGSGGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 15 - protein, 730 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTRTFGQGTKVEIKR

SEQ ID NO: 16 - protein, 731 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTRTFGQGTKVEIKRTGGGGSGGGGSGGGGSGGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 17 - protein, 731 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQIMIYLGSNRASGVPDRFSGSGSGTDFTLKISRVEAEDVGVYYCMQALQTPRTFGQGTKVEIKR

SEQ ID NO: 18 - protein, 732 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQIMIYLGSNRASGVPDRFSGSGSGTDFTLKISRVEAEDVGVYYCMQALQTPRTFGQGTKVEIKRTGGGGSGGGGSGGGGSGGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 19 - protein, 731 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 20 - protein, 732 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 21 - protein, 248 aa, Artificial Sequence
  Synthetic Polypeptide
IVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPISLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 22 - protein, 5 aa, Artificial Sequence
  Synthetic Polypeptide
SGGGS

SEQ ID NO: 23 - protein, 20 aa, Artificial Sequence
  Synthetic Polypeptide
GGGGSGGGGSGGGGSGGGGS

SEQ ID NO: 24 - DNA, 3535 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgaagtgcagctgctggaaagcggcggaggcctggtgcagcctggaggcagcctgagactgtcttgcgctgccagcggcttcaccttcagcttctacagcatgcactgggtccgacaggctccaggcaagggcctggaatgggtgtcccggatctacccctctggcggcgtgaccaaatacgccgacagcgtgaagggccggttcaccatcagccgggacaacagcaagaacaccctgtacctgcagatgaacagcctgcgggccgaggacaccgccgtgtactactgcacccggcagcggtacagaggccccaagtactactactacatggacgtgtggggcaagggcacaaccgtgaccgtgtctagcggaggcggaggatctggcggaggtggaagtggtggtggcggaagtggcggaggcggcagcgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtggaagccgaggacgtgggcgtgtactattgcatgcaggccctgcagaccccctggaccttcggccagggcaccaaggtggaaatcaagagatgaatctaga

SEQ ID NO: 25 - DNA, 3538 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtcgaagccgaggacgtgggcgtgtactactgcatgcaggccctgcagaccccctggaccttcggccagggcaccaaggtggaaatcaagcggacaggcggcggaggctctggcggaggtggaagcggaggcggaggaagtggcggaggcggctctgaggtgcagctgctggaatctggaggcggactggtgcagcctggcggcagcctgagactgtcttgcgctgccagcggcttcaccttcagcttctacagcatgcactgggtccgacaggcccctggcaagggcctggaatgggtgtcccggatctacccctctggcggcgtgaccaaatacgccgacagcgtgaagggccggttcaccatcagccgggacaacagcaagaacaccctgtacctgcagatgaacagcctgcgggccgaggacaccgccgtgtactattgcacccggcagcggtacagaggccccaagtactactactacatggacgtgtggggcaagggcaccaccgtgaccgtgtccagctgaatctaga

SEQ ID NO: 26 - DNA, 3532 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgaagtgcagctgctggaaagcggcggaggactggtgcagcctggcggctccctgagactgtcttgcgccgccagcggcttcaccttcagcggctacatcatggcctgggtccgacaggctccaggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactactgcacccggcagcggtacagaggccccaagtactactactacatggacgtgtggggcaagggcaccaccgtgaccgtgtctagcggaggcggaggatctggcggaggtggaagtggtggtggcggaagtggcggcggaggcagcgacatccagatgacccagagccccctgagcctgagcgtggcacctggcgagcctgccagcatcagctgcagaagcagccagagcctgctgcaccggaacggccacaactacctggactggtatctgcagaagcccggccagtccccccagctgctgatctacctgggcagcaacagagccagcggcgtgcccgagagattcagcggcagcggctccggcaccgacttcaccctgcggatcagccgggtggaagccgaggacgtgggcgtgtactattgcatgcaggctctgcaggccagaaccttcggccagggcaccaaggtggaaatcaagagatgaatctaga

SEQ ID NO: 27 - DNA, 3535 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgacatccagatgacccagagccccctgagcctgagcgtggcacctggcgagcctgccagcatcagctgcagaagcagccagagcctgctgcaccggaacggccacaactacctggactggtatctgcagaagcccggccagtccccccagctgctgatctacctgggcagcaacagagccagcggcgtgcccgagagattcagcggcagcggctccggcaccgacttcaccctgcggatcagccgggtcgaagccgaggacgtgggcgtgtactactgcatgcaggctctgcaggccagaaccttcggccagggcaccaaggtggaaatcaagcggacaggcggcggaggctctggcggaggtggaagcggaggcggaggaagtggcggaggcggctctgaggtgcagctgctggaatctggcggcggactggtgcagcctggcggcagcctgagactgtcttgcgccgccagcggcttcaccttcagcggctacatcatggcctgggtccgacaggcccctggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactattgcacccggcagcggtacagaggccccaagtactactactacatggacgtgtggggcaagggcaccaccgtgaccgtgtccagctgaatctaga

SEQ ID NO: 28 - DNA, 3532 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgaagtgcagctgctggaaagcggcggaggactggtgcagcctggaggcagcctgagactgtcttgcgccgccagcggcttcaccttcagcggctacatcatggcctgggtccgacaggctccaggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactactgcacccggcagcggtacagaggccccaagtactactactacatggacgtgtggggcaagggcaccaccgtgaccgtgtctagcggaggcggaggatctggcggaggtggaagtggtggtggcggaagtggcggcggaggcagcgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtggaagccgaggacgtgggcgtgtactattgcatgcaggccctgcagacccggaccttcggccagggcaccaaggtggaaatcaagagatgaatctaga

SEQ ID NO: 29 - DNA, 3535 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtcgaagccgaggacgtgggcgtgtactactgcatgcaggccctgcagacccggaccttcggccagggcaccaaggtggaaatcaagcggacaggcggcggaggctctggcggaggtggaagcggaggcggaggaagtggcggaggcggctctgaggtgcagctgctggaatctggcggcggactggtgcagcctggcggcagcctgagactgtcttgcgccgccagcggcttcaccttcagcggctacatcatggcctgggtccgacaggcccctggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactattgcacccggcagcggtacagaggccccaagtactactactacatggacgtgtggggcaagggcaccaccgtgaccgtgtccagctgaatctaga

SEQ ID NO: 30 - DNA, 3535 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgaagtgcagctgctggaaagcggcggaggactggtgcagcctggaggcagcctgagactgtcttgcgccgccagcggcttcaccttcagcggctacatcatggcctgggtccgacaggctccaggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactactgcacccggcagcggtacagaggccccaagtactactactacatggacgtgtggggcaagggcaccaccgtgaccgtgtctagcggaggcggaggatctggcggaggtggaagtggtggtggcggaagtggcggcggaggcagcgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagatcatgatctacctgggcagcaacagagccagcggcgtgcccgacagattcagcggcagcggctccggcaccgacttcaccctgaagatcagccgggtggaagccgaggacgtgggcgtgtactattgcatgcaggccctgcagacccccagaaccttcggccagggcaccaaggtggaaatcaagagatgaatctaga

SEQ ID NO: 31 - DNA, 3538 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagatcatgatctacctgggcagcaacagagccagcggcgtgcccgacagattcagcggcagcggctccggcaccgacttcaccctgaagatcagccgggtcgaagccgaggacgtgggcgtgtactactgcatgcaggccctgcagacccccagaaccttcggccagggcaccaaggtggaaatcaagcggacaggcggcggaggctctggcggaggtggaagcggaggcggaggaagtggcggaggcggctctgaggtgcagctgctggaatctggcggcggactggtgcagcctggcggcagcctgagactgtcttgcgccgccagcggcttcaccttcagcggctacatcatggcctgggtccgacaggcccctggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactattgcacccggcagcggtacagaggccccaagtactactactacatggacgtgtggggcaagggcaccaccgtgaccgtgtccagctgaatctaga

SEQ ID NO: 32 - DNA, 3535 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgaagtgcagctgctggaaagcggcggaggactggtgcagcctggaggcagcctgagactgtcttgcgccgccagcggcttcaccttcagcggctacatcatggcctgggtccgacaggctccaggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactactgcacccggcagcggtacagaggccccaagtactactactacatggacgtgtggggcaagggcaccaccgtgaccgtgtctagcggaggcggaggatctggcggaggtggaagtggtggtggcggaagtggcggcggaggcagcgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtggaagccgaggacgtgggcgtgtactattgcatgcaggccctgcagaccccctggaccttcggccagggcaccaaggtggaaatcaagagatgaatctaga

SEQ ID NO: 33 - DNA, 3538 bp, Artificial Sequence
  Synthetic Polynucleotide
atgggatggtcctgcatcatcctgtttctggtggctacagccacaggcgtgcactccgacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaagcggaccgtggccgctccctccgtgttcatcttcccaccctccgacgagcagctgaagtccggcaccgcctccgtggtctgcctgctgaacaacttctacccccgcgaggccaaggtgcagtggaaggtggacaacgccctgcagtccggcaactcccaggaatccgtgaccgagcaggactccaaggacagcacctactccctgtcctctaccctgaccctgtccaaggccgactacgagaagcacaaggtgtacgcctgcgaagtgacccaccagggcctgtccagccccgtgaccaagtccttcaaccggggcgagtgctgatgaggcgcgccttcgcgtcgagcatgcatctagggcggccaattccgcccctctccccccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcttcaagcgtattcaacaaggggctgaaggatgcccagaaggtaccccattgtatgggatctgatctggggcctcggtgcagatgctttacatgtgtttagtcgaggttaaaaaaacgtctaggccccccgaaccacggggacgtggttttcctttgaaaaacacgatgataatatggccacaaccatgggatggtcctgcatcatcctgtttctggtggccacagccacaggcgctcactccgaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctccgcctccaccaagggcccctctgtgttcccgctagcaccctccagcaagtccacctccggcggcaccgctgctctgggctgcctcgtcaaggactacttccccgagcccgtgaccgtgtcctggaactctggcgccctgaccagcggagtgcataccttccctgccgtgctccagtcctccggcctgtacagcctgtcctctgtcgtgaccgtgccctccagctccctgggcacccagacctacatctgcaacgtgaaccacaagccctccaacaccaaagtggacaagcgggtggaacccaagtcctgcgacacccacacctgtcccccttgccctgcccctgaactgctgggcggacccagcgtgttcctgttccccccaaagcccaaggacaccctgatgatctcccggacccccgaagtgacctgcgtggtggtggacgtgtcccacgaggaccctgaagtgaagtttaattggtacgtggacggcgtggaagtgcataacgccaagaccaagcccagagaggaacagtacaactccacctaccgggtggtgtccgtgctgaccgtgctgcaccaggactggctgaacggcaaagagtacaagtgcaaggtgtccaacaaggccctgcctgcccccatcgaaaagaccatcagcaaggccaagggccagcctcgcgagccccaggtgtacaccctgccccctagccgggaagagatgaccaagaaccaggtgtccctgacctgtctggtcaagggcttctacccctccgatatcgccgtggaatgggagtccaacggccagcccgagaacaactacaagaccaccccccctgtgctggacagcgacggctcattcttcctgtactccaagctgaccgtggacaagtcccggtggcagcagggcaacgtgttctcctgctccgtgatgcacgaggccctgcacaaccactacacccagaagtccctgtccctgtctcccggcaagtctggcggaggatccgacatccagatgacccagagccccctgagcctgcccgtgacacctggcgagcctgccagcatcagctgcagaagcagccagagcctgctgcacagcaacggctacaactacctggactggtatctgcagaagcccggccagtccccccagctgctgatctacctgggcagcaacagagccagcggcgtgcccgacagattcagcggcagcggctccggcaccgacttcaccctgaagatcagccgggtcgaagccgaggacgtgggcgtgtactactgcatgcaggccctgcagaccccctggaccttcggccagggcaccaaggtggaaatcaagcggacaggcggcggaggctctggcggaggtggaagcggaggcggaggaagtggcggaggcggctctgaggtgcagctgctggaatctggcggcggactggtgcagcctggcggcagcctgagactgtcttgcgccgccagcggcttcaccttcagcggctacatcatggcctgggtccgacaggcccctggcaagggcctggaatgggtgtcctacatctaccccagcggcggcatcaccgtgtacgccgacagcgtgaagggccggttcaccatcagccgggacaacagcaagaacaccctgtacctgcagatgaacagcctgcgggccgaggacaccgccgtgtactattgcacccggcagcggtacagaggccccaagtactactactacatggacgtgtggggcaagggcaccaccgtgaccgtgtccagctgaatctaga

SEQ ID NO: 34 - protein, 16 aa, Artificial Sequence
  Synthetic Polypeptide
RSSQSLLHSNGYNYLD

SEQ ID NO: 35 - protein, 16 aa, Artificial Sequence
  Synthetic Polypeptide
RSSQSLLHRNGHNYLD

SEQ ID NO: 36 - protein, 7 aa, Artificial Sequence
  Synthetic Polypeptide
LGSNRAS

SEQ ID NO: 37 - protein, 9 aa, Artificial Sequence
  Synthetic Polypeptide
MQALQTPWT

SEQ ID NO: 38 - protein, 8 aa, Artificial Sequence
  Synthetic Polypeptide
MQALQART

SEQ ID NO: 39 - protein, 8 aa, Artificial Sequence
  Synthetic Polypeptide
MQALQTRT

SEQ ID NO: 40 - protein, 9 aa, Artificial Sequence
  Synthetic Polypeptide
MQALQTPRT

SEQ ID NO: 41 - protein, 5 aa, Artificial Sequence
  Synthetic Polypeptide
GYIMA

SEQ ID NO: 42 - protein, 5 aa, Artificial Sequence
  Synthetic Polypeptide
FYSMH

SEQ ID NO: 43 - protein, 17 aa, Artificial Sequence
  Synthetic Polypeptide
YIYPSGGITVYADSVKG

SEQ ID NO: 44 - protein, 17 aa, Artificial Sequence
  Synthetic Polypeptide
RIYPSGGVTKYADSVKG

SEQ ID NO: 45 - protein, 14 aa, Artificial Sequence
  Synthetic Polypeptide
QRYRGPKYYYYMDV

SEQ ID NO: 46 - protein, 213 aa, Artificial Sequence
  Synthetic Polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 48 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 49 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 50 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 51 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSRYIMVWVRQAPGKGLEWVSRIYPSGGYTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 52 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSRYIMVWVRQAPGKGLEWVSRIYPSGGYTRYADSVKGRFTISRDNSKNTLYLQMNSLRAEDTAVYYCTRQRYRGPKYYYYMDVWGKGTTVTVSS

SEQ ID NO: 53 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYHMHWVRQAPGKGLEWVSRIVPSGGMTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 54 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYHMHWVRQAPGKGLEWVSRIVPSGGMTRYADSVKGRFTISRDNSKNTLYLQMNSLRAEDTAVYYCTRQRYRGPKYYYYMDVWGKGTTVTVSS

SEQ ID NO: 55 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYIMGWVRQAPGKGLEWVSRIYPSGGATQYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 56 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYIMGWVRQAPGKGLEWVSRIYPSGGATQYADSVKGRFTISRDNSKNTLYLQMNSLRAEDTAVYYCTRQRYRGPKYYYYMDVWGKGTTVTVSS

SEQ ID NO: 57 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDIGVYYCMQGRHRPYTFGQGTRLEIKR

SEQ ID NO: 58 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDIGVYYCMQGRHRPYTFGQGTRLEIKRTGGGGSGGGGSGGGGSGGGGSEVQLLESGGGLVQPGGSLRLSCAASGFTFSGYIMAWVRQAPGKGLEWVSYIYPSGGITVYADSVKGRFTISRDNSKNTLYLQMNSLRAEDTAVYYCTRQRYRGPKYYYYMDVWGKGTTVTVSS

SEQ ID NO: 59 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMQWVRQAPGKGLEWVSYIYPSGGHTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 60 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMQWVRQAPGKGLEWVSYIYPSGGHTKYADSVKGRFTISRDNSKNTLYLQMNSLRAEDTAVYYCTRQRYRGPKYYYYMDVWGKGTTVTVSS

SEQ ID NO: 61 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSMYTMNWVRQAPGKGLEWVSRIYPSGGKTLYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 62 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSMYTMNWVRQAPGKGLEWVSRIYPSGGKTLYADSVKGRFTISRDNSKNTLYLQMNSLRAEDTAVYYCTRQRYRGPKYYYYMDVWGKGTTVTVSS

SEQ ID NO: 63 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSRYVMHWVRQAPGKGLEWVSSIWPSGGMTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 64 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSRYVMHWVRQAPGKGLEWVSSIWPSGGMTKYADSVKGRFTISRDNSKNTLYLQMNSLRAEDTAVYYCTRQRYRGPKYYYYMDVWGKGTTVTVSS

SEQ ID NO: 65 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYIMGWVRQAPGKGLEWVSRIYPSGGTTFYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 66 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYIMGWVRQAPGKGLEWVSRIYPSGGTTFYADSVKGRFTISRDNSKNTLYLQMNSLRAEDTAVYYCTRQRYRGPKYYYYMDVWGKGTTVTVSS

SEQ ID NO: 67 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMYWVRQAPGKGLEWVSRIYPSGGITHYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 68 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMYWVRQAPGKGLEWVSRIYPSGGITHYADSVKGRFTISRDNSKNTLYLQMNSLRAEDTAVYYCTRQRYRGPKYYYYMDVWGKGTTVTVSS

SEQ ID NO: 69 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYNMHWVRQAPGKGLEWVSYISPSGGKTKYTDSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 70 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYNMHWVRQAPGKGLEWVSYISPSGGKTKYTDSVKGRFTISRDNSKNTLYLQMNSLRAEDTAVYYCTRQRYRGPKYYYYMDVWGKGTTVTVSS

SEQ ID NO: 71 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSRYIMGWVRQAPGKGLEWVSSIYPSGGVTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 72 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSRYIMGWVRQAPGKGLEWVSSIYPSGGVTRYADSVKGRFTISRDNSKNTLYLQMNSLRAEDTAVYYCTRQRYRGPKYYYYMDVWGKGTTVTVSS

SEQ ID NO: 73 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSRYIMHWVRQAPGKGLEWVSSIYPSGGVTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 74 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSRYIMHWVRQAPGKGLEWVSSIYPSGGVTKYADSVKGRFTISRDNSKNTLYLQMNSLRAEDTAVYYCTRQRYRGPKYYYYMDVWGKGTTVTVSS

SEQ ID NO: 75 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYSMHWVRQAPGKGLEWVSRIYPSGGVTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 76 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYSMHWVRQAPGKGLEWVSRIYPSGGVTKYADSVKGRFTISRDNSKNTLYLQMNSLRAEDTAVYYCTRQRYRGPKYYYYMDVWGKGTTVTVSS

SEQ ID NO: 77 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYVMGWVRQAPGKGLEWVSRIYPSGGLTQYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 78 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYVMGWVRQAPGKGLEWVSRIYPSGGLTQYADSVKGRFTISRDNSKNTLYLQMNSLRAEDTAVYYCTRQRYRGPKYYYYMDVWGKGTTVTVSS

SEQ ID NO: 79 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMQWVRQAPGKGLEWVSSIWPSGGKTVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 80 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMQWVRQAPGKGLEWVSSIWPSGGKTVYADSVKGRFTISRDNSKNTLYLQMNSLRAEDTAVYYCTRQRYRGPKYYYYMDVWGKGTTVTVSS

SEQ ID NO: 81 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMHWVRQAPGKGLEWVSGIWPSGGRTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 82 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMHWVRQAPGKGLEWVSGIWPSGGRTKYADSVKGRFTISRDNSKNTLYLQMNSLRAEDTAVYYCTRQRYRGPKYYYYMDVWGKGTTVTVSS

SEQ ID NO: 83 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYIMHWVRQAPGKGLEWVSSIYPSGGNTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 84 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYIMHWVRQAPGKGLEWVSSIYPSGGNTKYADSVKGRFTISRDNSKNTLYLQMNSLRAEDTAVYYCTRQRYRGPKYYYYMDVWGKGTTVTVSS

SEQ ID NO: 85 - protein, 487 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFS

SEQ ID NO: 86 - protein, 621 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFS

SEQ ID NO: 87 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSPYIMHWVRQAPGKGLEWVSRIYPSGGATVYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 88 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSPYIMHWVRQAPGKGLEWVSRIYPSGGATVYADSVKGRFTISRDNSKNTLYLQMNSLRAEDTAVYYCTRQRYRGPKYYYYMDVWGKGTTVTVSS

SEQ ID NO: 89 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSMYIMHWVRQAPGKGLEWVSSIYPSGGMTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 90 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSMYIMHWVRQAPGKGLEWVSSIYPSGGMTKYADSVKGRFTISRDNSKNTLYLQMNSLRAEDTAVYYCTRQRYRGPKYYYYMDVWGKGTTVTVSS

SEQ ID NO: 91 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYSMHWVRQAPGKGLEWVSVIYPSGGKTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 92 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYSMHWVRQAPGKGLEWVSVIYPSGGKTRYADSVKGRFTISRDNSKNTLYLQMNSLRAEDTAVYYCTRQRYRGPKYYYYMDVWGKGTTVTVSS

SEQ ID NO: 93 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSMYVMHWVRQAPGKGLEWVSSIYPSGGLTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 94 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSMYVMHWVRQAPGKGLEWVSSIYPSGGLTKYADSVKGRFTISRDNSKNTLYLQMNSLRAEDTAVYYCTRQRYRGPKYYYYMDVWGKGTTVTVSS

SEQ ID NO: 95 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYTMHWVRQAPGKGLEWVSSIYPSGGFTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 96 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYTMHWVRQAPGKGLEWVSSIYPSGGFTRYADSVKGRFTISRDNSKNTLYLQMNSLRAEDTAVYYCTRQRYRGPKYYYYMDVWGKGTTVTVSS

SEQ ID NO: 97 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSHYVMHWVRQAPGKGLEWVSSIYPSGGLTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 98 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSHYVMHWVRQAPGKGLEWVSSIYPSGGLTKYADSVKGRFTISRDNSKNTLYLQMNSLRAEDTAVYYCTRQRYRGPKYYYYMDVWGKGTTVTVSS

SEQ ID NO: 99 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMQWVRQAPGKGLEWVSSIYPSGGMTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 100 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMQWVRQAPGKGLEWVSSIYPSGGMTKYADSVKGRFTISRDNSKNTLYLQMNSLRAEDTAVYYCTRQRYRGPKYYYYMDVWGKGTTVTVSS

SEQ ID NO: 101 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYVMHWVRQAPGKGLEWVSSIWPSGGFTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 102 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYVMHWVRQAPGKGLEWVSSIWPSGGFTKYADSVKGRFTISRDNSKNTLYLQMNSLRAEDTAVYYCTRQRYRGPKYYYYMDVWGKGTTVTVSS

SEQ ID NO: 103 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYIMQWVRQAPGKGLEWVSSIYPSGGRTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 104 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYIMQWVRQAPGKGLEWVSSIYPSGGRTKYADSVKGRFTISRDNSKNTLYLQMNSLRAEDTAVYYCTRQRYRGPKYYYYMDVWGKGTTVTVSS

SEQ ID NO: 105 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYNMAWVRQAPGKGLEWVSRIYPSGGMTQYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 106 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYNMAWVRQAPGKGLEWVSRIYPSGGMTQYADSVKGRFTISRDNSKNTLYLQMNSLRAEDTAVYYCTRQRYRGPKYYYYMDVWGKGTTVTVSS

SEQ ID NO: 107 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSWYVMHWVRQAPGKGLEWVSSIYPSGGKTSYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 108 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSWYVMHWVRQAPGKGLEWVSSIYPSGGKTSYADSVKGRFTISRDNSKNTLYLQMNSLRAEDTAVYYCTRQRYRGPKYYYYMDVWGKGTTVTVSS

SEQ ID NO: 109 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYVMSWVRQAPGKGLEWVSRIYPSGGVTKYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 110 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYVMSWVRQAPGKGLEWVSRIYPSGGVTKYADSVKGRFTISRDNSKNTLYLQMNSLRAEDTAVYYCTRQRYRGPKYYYYMDVWGKGTTVTVSS

SEQ ID NO: 111 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYNMVWVRQAPGKGLEWVSRIWPSGGKTTYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 112 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYNMVWVRQAPGKGLEWVSRIWPSGGKTTYADSVKGRFTISRDNSKNTLYLQMNSLRAEDTAVYYCTRQRYRGPKYYYYMDVWGKGTTVTVSS

SEQ ID NO: 113 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYTMVWVRQAPGKGLEWVSRIYPSGGVTQYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 114 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYTMVWVRQAPGKGLEWVSRIYPSGGVTQYADSVKGRFTISRDNSKNTLYLQMNSLRAEDTAVYYCTRQRYRGPKYYYYMDVWGKGTTVTVSS

SEQ ID NO: 115 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYVMHWVRQAPGKGLEWVSRIYPSGGLTNYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 116 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYVMHWVRQAPGKGLEWVSRIYPSGGLTNYADSVKGRFTISRDNSKNTLYLQMNSLRAEDTAVYYCTRQRYRGPKYYYYMDVWGKGTTVTVSS

SEQ ID NO: 117 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSQYVMHWVRQAPGKGLEWVSSIWPSGGHTRYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 118 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSQYVMHWVRQAPGKGLEWVSSIWPSGGHTRYADSVKGRFTISRDNSKNTLYLQMNSLRAEDTAVYYCTRQRYRGPKYYYYMDVWGKGTTVTVSS

SEQ ID NO: 119 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSNYVMHWVRQAPGKGLEWVSSIWPSGGKTKYADSVKGRFTISRDNSKNTLYLQMNSLRAEDTAVYYCTRQRYRGPKYYYYMDAWGQGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 120 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSNYVMHWVRQAPGKGLEWVSSIWPSGGKTKYADSVKGRFTISRDNSKNTLYLQMNSLRAEDTAVYYCTRQRYRGPKYYYYMDAWGQGTTVTVSS

SEQ ID NO: 121 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSEVQLLESGGGLVQPGGSLRLSCAASGFTFSFYSMHWVRQAPGKGLEWVSRIYPSGGITSYADSVKGRFTISRDNSKNTLYLQMNSLRAEDTAVYYCTRQRYRGPKYYYYMDVWGKGTTVTVSSGGGGSGGGGSGGGGSGGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKR

SEQ ID NO: 122 - protein, 714 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGSDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIKRTGGGGSGGGGSGGGGSGGGGSEVQLLESGGGLVQPGGSLRLSCAASGFTFSFYSMHWVRQAPGKGLEWVSRIYPSGGITSYADSVKGRFTISRDNSKNTLYLQMNSLRAEDTAVYYCTRQRYRGPKYYYYMDVWGKGTTVTVSS

SEQ ID NO: 123 - protein, 123 aa, Artificial Sequence
  Synthetic Polypeptide
EVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSS

SEQ ID NO: 124 - protein, 123 aa, Artificial Sequence
  Synthetic Polypeptide
EVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSS

SEQ ID NO: 125 - protein, 123 aa, Artificial Sequence
  Synthetic Polypeptide
EVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSS

SEQ ID NO: 126 - protein, 123 aa, Artificial Sequence
  Synthetic Polypeptide
EVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSS

SEQ ID NO: 127 - protein, 113 aa, Artificial Sequence
  Synthetic Polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 128 - protein, 113 aa, Artificial Sequence; identical to SEQ ID NO: 127
  Synthetic Polypeptide

SEQ ID NO: 129 - protein, 113 aa, Artificial Sequence; identical to SEQ ID NO: 127
  Synthetic Polypeptide

SEQ ID NO: 130 - protein, 113 aa, Artificial Sequence; identical to SEQ ID NO: 127
  Synthetic Polypeptide

SEQ ID NO: 131 - protein, 16 aa, Artificial Sequence
  Synthetic Polypeptide
RSSQSLLHSNGYNYLD

SEQ ID NO: 132 - protein, 5 aa, Artificial Sequence
  Synthetic Polypeptide
QYVMH

SEQ ID NO: 133 - protein, 17 aa, Artificial Sequence
  Synthetic Polypeptide
SIWPSGGHTRYADSVKG

SEQ ID NO: 134 - protein, 14 aa, Artificial Sequence
  Synthetic Polypeptide
QRYRGPKYYYYMDV

SEQ ID NO: 135 - protein, 5 aa, Artificial Sequence
  Synthetic Polypeptide
WYVMH

SEQ ID NO: 136 - protein, 17 aa, Artificial Sequence
  Synthetic Polypeptide
SIYPSGGKTSYADSVKG

SEQ ID NO: 137 - protein, 5 aa, Artificial Sequence
  Synthetic Polypeptide
WYSMH

SEQ ID NO: 138 - protein, 17 aa, Artificial Sequence
  Synthetic Polypeptide
VIYPSGGKTRYADSVKG

SEQ ID NO: 139 - protein, 5 aa, Artificial Sequence
  Synthetic Polypeptide
HYVMH

SEQ ID NO: 140 - protein, 17 aa, Artificial Sequence
  Synthetic Polypeptide
SIYPSGGLTKYADSVKG

SEQ ID NO: 141 - protein, 712 aa, Artificial Sequence
  Synthetic
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 142 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 143 - protein, 712 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 144 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 145 - protein, 712 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 146 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 147 - protein, 712 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 148 - protein, 713 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEIKR

SEQ ID NO: 149 - protein, 470 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 150 - protein, 471 aa, Artificial Sequence
  Synthetic Polypeptide
MGWSCIILFLVATATGAHSEVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGG

SEQ ID NO: 151 - protein, 710 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 152 - protein, 711 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSQYVMHWVRQAPGKCLEWVSSIWPSGGHTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 153 - protein, 710 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 154 - protein, 711 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSWYVMHWVRQAPGKCLEWVSSIYPSGGKTSYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 155 - protein, 710 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 156 - protein, 711 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSHYVMHWVRQAPGKCLEWVSSIYPSGGLTKYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 157 - protein, 710 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGGGSEVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 158 - protein, 711 aa, Artificial Sequence
  Synthetic Polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGSGGGSEVQLLESGGGLVQPGGSLRLSCAASGFTFSWYSMHWVRQAPGKCLEWVSVIYPSGGKTRYADSVKGRFTISRDNSKNTLYLQMNSLRAEDTAVYYCARQRYRGPKYYYYMDVWGQGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGCGTKVEI

SEQ ID NO: 159 - protein, 5 aa, Artificial Sequence
  Synthetic
HYIMM

SEQ ID NO: 160 - protein, 17 aa, Artificial Sequence
  Synthetic
GIYSSGGITVYADSVKG

SEQ ID NO: 161 - protein, 13 aa, Artificial Sequence
  Synthetic
RRIGVPRRDEFDI

SEQ ID NO: 162 - protein, 11 aa, Artificial Sequence
  Synthetic
RASQSISSWLA

SEQ ID NO: 163 - protein, 7 aa, Artificial Sequence
  Synthetic
KASTLES

SEQ ID NO: 164 - protein, 8 aa, Artificial Sequence
  Synthetic
QQYNTYWT

What is claimed is:

1. A bispecific antibody, comprising:
a first polypeptide that comprises a light chain of a first antibody, the light chain comprising a light chain variable region ($V_L$) and a light chain constant region ($C_L$); and
a second polypeptide that comprises a heavy chain of the first antibody, the heavy chain comprising a heavy chain variable region ($V_H$) and a heavy chain constant region ($C_H$), wherein the first polypeptide or the second polypeptide further comprises a second antibody, which is a single chain antibody and is fused to the C-terminus of either the first polypeptide or the second polypeptide;
wherein the first antibody binds active plasma kallikrein (pKal) and comprises a heavy chain complementarity determining region (HCDR) 1 set forth as HYIMM (SEQ ID NO: 159), a HCDR2 set forth as GIYSSG-GITVYADSVKG (SEQ ID NO: 160), and a HCDR3 set forth as RRIGVPRRDEFDI (SEQ ID NO: 161); and a light chain complementarity determining region (LCDR) 1 set forth as RASQSISSWLA (SEQ ID NO: 162), a LCDR2 set forth as KASTLES (SEQ ID NO: 163), and a LCDR 3 set forth as QQYNTYWT (SEQ ID NO: 164); and
wherein the second antibody binds active Factor XII (FXIIa) and comprises
(i) a heavy chain comprising a HCDR1 set forth as SEQ ID NO: 41, a HCDR2 set forth as SEQ ID NO: 43, and a HCDR3 set forth as SEQ ID NO: 45, and a light chain comprising a LCDR1 set forth as SEQ ID NO: 34, a LCDR2 set forth as SEQ ID NO: 36, and a LCDR3 set forth as SEQ ID NO: 37;
(ii) a heavy chain comprising a HCDR1 set forth as SEQ ID NO: 41, a HCDR2 set forth as SEQ ID NO: 43, and a HCDR3 set forth as SEQ ID NO: 45, and a light chain comprising a LCDR1 set forth as SEQ ID NO: 35, a LCDR2 set forth as SEQ ID NO: 36, and a LCDR3 set forth as SEQ ID NO: 38;
(iii) a heavy chain comprising a HCDR1 set forth as SEQ ID NO: 41, a HCDR2 set forth as SEQ ID NO: 43, and a HCDR3 set forth as SEQ ID NO: 45, and a light chain comprising a LCDR1 set forth as SEQ ID NO: 34, a LCDR2 set forth as SEQ ID NO: 36, and a LCDR3 set forth as SEQ ID NO: 39;
(iv) a heavy chain comprising a HCDR1 set forth as SEQ ID NO: 41, a HCDR2 set forth as SEQ ID NO: 43, and a HCDR3 set forth as SEQ ID NO: 45, and a light chain comprising a LCDR1 set forth as SEQ ID NO: 34, a LCDR2 set forth as SEQ ID NO: 36, and a LCDR3 set forth as SEQ ID NO: 40;
(v) a heavy chain comprising a HCDR1 set forth as SEQ ID NO: 42, a HCDR2 set forth as SEQ ID NO: 44, and a HCDR3 set forth as SEQ ID NO: 45, and a light chain comprising a LCDR1 set forth as SEQ ID NO: 34, a LCDR2 set forth as SEQ ID NO: 36, and a LCDR3 set forth as SEQ ID NO: 37;
(vi) a heavy chain comprising a HCDR1 set forth as SEQ ID NO: 132, a HCDR2 set forth as SEQ ID NO: 133, and a HCDR3 set forth as SEQ ID NO: 134, and a light chain comprising a LCDR1 set forth as SEQ ID NO: 131, a LCDR2 set forth as SEQ ID NO: 36, and a LCDR3 set forth as SEQ ID NO: 37;
(vii) a heavy chain comprising a HCDR1 set forth as SEQ ID NO: 135, a HCDR2 set forth as SEQ ID NO: 136, and a HCDR3 set forth as SEQ ID NO: 134, and a light chain comprising a LCDR1 set forth as SEQ ID NO: 131, a LCDR2 set forth as SEQ ID NO: 36, and a LCDR3 set forth as SEQ ID NO: 37;
(viii) a heavy chain comprising a HCDR1 set forth as SEQ ID NO: 137, a HCDR2 set forth as SEQ ID NO: 138, and a HCDR3 set forth as SEQ ID NO: 134, and a light chain comprising a LCDR1 set forth as SEQ ID NO: 131, a LCDR2 set forth as SEQ ID NO: 36, and a LCDR3 set forth as SEQ ID NO: 37; or
(ix) a heavy chain comprising a HCDR1 set forth as SEQ ID NO: 139, a HCDR2 set forth as SEQ ID NO: 140, and a HCDR3 set forth as SEQ ID NO: 134, and a light chain comprising a LCDR1 set forth as SEQ ID NO: 131, a LCDR2 set forth as SEQ ID NO: 36, and a LCDR3 set forth as SEQ ID NO: 37.

2. The bispecific antibody of claim 1, wherein the second antibody is fused to the C-terminus of the second polypeptide.

3. The bispecific antibody of claim 1, wherein the first antibody is an IgG.

4. The bispecific antibody of claim 3, wherein the IgG comprises a mutated heavy chain, which, as compared with the wild-type counterpart, has the C-terminal lysine residue deleted or mutated.

5. The bispecific antibody of claim 4, wherein the heavy chain of the first antibody contains a C-terminal glycine residue, instead of a lysine residue.

6. The bispecific antibody of claim 1, wherein the second antibody does not contain a KR motif at its C-terminus.

7. The bispecific antibody of claim 1, wherein the bispecific antibody is tetravalent.

8. The bispecific antibody of claim 2, wherein the second polypeptide comprises a peptide linker between the heavy chain of the first antibody and the second antibody.

9. The bispecific antibody of claim 1, wherein the $C_L$ is a kappa light chain or a lambda light chain.

10. The bispecific antibody of claim 1, wherein in the second antibody, the $V_H$ is fused to the N-terminus of the $V_L$ or fused to the C-terminus of the $V_L$.

11. The bispecific antibody of claim 8, wherein the second antibody comprises a peptide linker between the $V_H$ and $V_L$ regions.

12. The bispecific antibody of claim 1, wherein a disulfide bond is formed between the $V_H$ chain and the $V_L$ chain in the second antibody.

13. The bispecific antibody of claim 12, wherein the disulfide bond is formed between a cysteine residue at an amino acid corresponding to position 44 in the $V_H$ chain of SEQ ID NO: 123 and a cysteine residue introduced at an amino acid corresponding to position 100 in the $V_L$ chain of SEQ ID NO: 127, wherein the sequence of the bispecific antibody comprises any of SEQ ID NOs: 47-50, 123-126, 141-148, and 151-158, wherein the amino acid position is based on Chothia numbering.

14. The bispecific antibody of claim 1, wherein the $V_H$ of the first antibody comprises the amino acid sequence of SEQ ID NO:1; and wherein the $V_L$ of the first antibody comprises the amino acid sequence of SEQ ID NO:2.

15. The bispecific antibody of claim 14, wherein the heavy chain of the first antibody comprises the amino acid sequence of residues 20-470 of SEQ ID NO: 9.

16. The bispecific antibody of claim 15, wherein the heavy chain of the first antibody comprises the amino acid sequence of SEQ ID NO:9, 149, or 150.

17. The bispecific antibody of claim 1, wherein the $V_H$ of the second antibody comprises any one of the amino acid sequences of SEQ ID NOs:3, 4, and 123-126; and wherein the $V_L$ of the second antibody comprises residues 1-111 of any one of the amino acid sequences of SEQ ID NOs:5-8 and 127.

18. The bispecific antibody of claim 1, wherein the first polypeptide comprises the amino acid sequence of SEQ ID NO:10 and the second polypeptide comprises the amino acid sequence selected from the group consisting of SEQ ID NOs: 11-20, 47-122, 141-148, and 151-158.

19. An isolated nucleic acid or nucleic acid set, comprising a first nucleotide sequence encoding the first polypeptide and a second nucleotide sequence encoding the second polypeptide, wherein the first polypeptide and the second polypeptide are set forth in claim 1.

20. A pharmaceutical composition comprising (i) a bispecific antibody of claim 1, and (ii) a pharmaceutically acceptable carrier.

21. A host cell, comprising the isolated nucleic acid or nucleic acid set of claim 19, wherein the first and second nucleotide sequences are located on at least one nucleic acid molecule, optionally wherein:
(i) a first vector comprises the first nucleotide sequence and the second nucleotide sequence; or
(ii) a first vector comprises the first nucleotide sequence and a second vector comprises the second nucleotide sequence.

22. A method for preparing a bispecific antibody, comprising:
culturing the host cell of claim 21 under conditions allowing for expression of the first polypeptide and the second polypeptide; and
isolating the bispecific antibody that comprises the first polypeptide and the second polypeptide.

23. A bispecific antibody, which comprises a first antibody binding to active plasma kallikrein (pKal) and a second antibody binding to active Factor FXII (FXIIa), wherein the first antibody comprises a heavy chain complementarity determining region (HCDR) 1 set forth as HYIMM (SEQ ID NO: 159), a HCDR2 set forth as GIYSSGGITVYADSVKG (SEQ ID NO: 160), and a HCDR3 set forth as RRIGVPRRDEFDI (SEQ ID NO: 161); and a light chain complementarity determining region (LCDR) 1 set forth as RASQSISSWLA (SEQ ID NO: 162), a LCDR2 set forth as KASTLES (SEQ ID NO: 163), and a LCDR 3 set forth as QQYNTYWT (SEQ ID NO: 164); and
wherein the second antibody comprises
(i) a HCDR1 set forth as SEQ ID NO: 41, a HCDR2 set forth as SEQ ID NO: 43, and a HCDR3 set forth as SEQ ID NO: 45, and a LCDR1 set forth as SEQ ID NO: 34, a LCDR2 set forth as SEQ ID NO: 36, and a LCDR3 set forth as SEQ ID NO: 37;
(ii) a HCDR1 set forth as SEQ ID NO: 41, a HCDR2 set forth as SEQ ID NO: 43, and a HCDR3 set forth as SEQ ID NO: 45, and a LCDR1 set forth as SEQ ID NO: 35, a LCDR2 set forth as SEQ ID NO: 36, and a LCDR3 set forth as SEQ ID NO: 38;
(iii) a HCDR1 set forth as SEQ ID NO: 41, a HCDR2 set forth as SEQ ID NO: 43, and a HCDR3 set forth as SEQ ID NO: 45, and a LCDR1 set forth as SEQ ID NO: 34, a LCDR2 set forth as SEQ ID NO: 36, and a LCDR3 set forth as SEQ ID NO: 39;
(iv) a HCDR1 set forth as SEQ ID NO: 41, a HCDR2 set forth as SEQ ID NO: 43, and a HCDR3 set forth as SEQ ID NO: 45, and a LCDR1 set forth as SEQ ID NO: 34, a LCDR2 set forth as SEQ ID NO: 36, and a LCDR3 set forth as SEQ ID NO: 40;
(v) a HCDR1 set forth as SEQ ID NO: 42, a HCDR2 set forth as SEQ ID NO: 44, and a HCDR3 set forth as SEQ ID NO: 45, and a LCDR1 set forth as SEQ ID NO: 34, a LCDR2 set forth as SEQ ID NO: 36, and a LCDR3 set forth as SEQ ID NO: 37;
(vi) a HCDR1 set forth as SEQ ID NO: 132, a HCDR2 set forth as SEQ ID NO: 133, and a HCDR3 set forth as SEQ ID NO: 134, and a LCDR1 set forth as SEQ ID NO: 131, a LCDR2 set forth as SEQ ID NO: 36, and a LCDR3 set forth as SEQ ID NO: 37;
(vii) a HCDR1 set forth as SEQ ID NO: 135, a HCDR2 set forth as SEQ ID NO: 136, and a HCDR3 set forth as SEQ ID NO: 134, and a LCDR1 set forth as SEQ ID NO: 131, a LCDR2 set forth as SEQ ID NO: 36, and a LCDR3 set forth as SEQ ID NO: 37;
(viii) a HCDR1 set forth as SEQ ID NO: 137, a HCDR2 set forth as SEQ ID NO: 138, and a HCDR3 set forth as SEQ ID NO: 134, and a LCDR1 set forth as SEQ ID NO: 131, a LCDR2 set forth as SEQ ID NO: 36, and a LCDR3 set forth as SEQ ID NO: 37; or
(ix) a HCDR1 set forth as SEQ ID NO: 139, a HCDR2 set forth as SEQ ID NO: 140, and a HCDR3 set forth as SEQ ID NO: 134, and a LCDR1 set forth as SEQ ID NO: 131, a LCDR2 set forth as SEQ ID NO: 36, and a LCDR3 set forth as SEQ ID NO: 37.

24. The bispecific antibody of claim 23, wherein the second antibody comprises a $V_H$ chain that comprises any one of the amino acid sequences of SEQ ID NOs:3, 4, and 123-126, and a $V_L$ chain that comprises any one of the amino acid sequences of SEQ ID NOs:5-8 and 127.

25. The bispecific antibody of claim 23, wherein the $V_H$ of the first antibody comprises the amino acid sequence of SEQ ID NO:1; and wherein the $V_L$ of the first antibody comprises the amino acid sequence of SEQ ID NO:2.

26. A pharmaceutical composition comprising (i) a bispecific antibody of claim 23, and (ii) a pharmaceutically acceptable carrier.

* * * * *